US012760104B2

(12) United States Patent
Iadonato et al.

(10) Patent No.: US 12,760,104 B2
(45) Date of Patent: Oct. 13, 2026

(54) ANTI-VISTA ANTIBODIES AND USES THEREOF

(71) Applicant: Kineta, Inc., Seattle, WA (US)

(72) Inventors: Shawn P. Iadonato, Seattle, WA (US); Thierry Guillaudeux, Seattle, WA (US); Eric J. Tarcha, Seattle, WA (US); David Scott Johnson, South San Francisco, CA (US); Adam Shultz Adler, South San Francisco, CA (US); Rena Aviva Mizrahi, South San Francisco, CA (US); Yoong Wearn Lim, South San Francisco, CA (US); Michael Asensio, South San Francisco, CA (US)

(73) Assignee: Kineta, Inc., Seattle, WA (US)

( * ) Notice: Subject to any disclaimer, the term of this patent is extended or adjusted under 35 U.S.C. 154(b) by 493 days.

(21) Appl. No.: 18/276,417

(22) PCT Filed: Feb. 18, 2022

(86) PCT No.: PCT/US2022/016912
§ 371 (c)(1),
(2) Date: Aug. 8, 2023

(87) PCT Pub. No.: WO2022/178203
PCT Pub. Date: Aug. 25, 2022

(65) Prior Publication Data

US 2024/0132593 A1 Apr. 25, 2024

Related U.S. Application Data

(60) Provisional application No. 63/150,995, filed on Feb. 18, 2021.

(51) Int. Cl.
*C07K 16/28* (2006.01)
*A61K 39/00* (2006.01)
*A61P 35/00* (2006.01)

(52) U.S. Cl.
CPC .......... *C07K 16/2827* (2013.01); *A61P 35/00* (2018.01); *C07K 16/2818* (2013.01); *A61K 39/00* (2013.01); *A61K 2039/505* (2013.01); *A61K 2039/507* (2013.01); *C07K 2317/33* (2013.01); *C07K 2317/34* (2013.01); *C07K 2317/52* (2013.01); *C07K 2317/565* (2013.01); *C07K 2317/622* (2013.01); *C07K 2317/732* (2013.01); *C07K 2317/734* (2013.01); *C07K 2317/76* (2013.01)

(58) Field of Classification Search
None
See application file for complete search history.

(56) References Cited

U.S. PATENT DOCUMENTS

2017/0088620 A1 3/2017 Nioi et al.

FOREIGN PATENT DOCUMENTS

WO 2020/014327 A2 1/2020
WO 2020/140094 A1 7/2020

OTHER PUBLICATIONS

Mulati et al. (British Journal of Cancer vol. 120, pp. 115-127, Nov. 2018).*
Guillaudeux et al. (Kineta Poster, AACR Vista, Oct. 2020).*
Iadonato et al., Highly potent fully human anti-VISTA antibodies efficiently abrogate the interaction of this new target checkpoint inhibitor to its different putative receptors at different pH. Annals of Oncology. 2020;31(S7):S1448-S1449, Abstract 76P.
International Search Report and Written Opinion for Application No. PCT/US2022/06912, dated Jul. 18, 2022, 13 pages.
Guillaudeux et al., Highly Potent Fully Human anti-VISTA Antibodies A New Target Checkpoint Inhibitor against Immunosuppressive Myeloid Cells. Kineta Poster, AACR Vista, 1 page, Oct. 2020.
Guillaudeux et al., Highly Potent Fully Human anti-VISTA Antibodies A New Target Checkpoint Inhibitor against Immunosuppressive Myeloid Cells. Kineta Poster, SITC Vista Poster, 1 page, Nov. 2020.
Iadonato et al., Highly Potent Fully Human Anti-VISTA Antibodies Efficiently Abrogate the Interaction of VISTA to Its Putative Receptors at Different pH. Kineta Poster, ESMO Virtual Congress. 1 page, Dec. 2020.
Chapoval et al., New Immunological Checkpoints for Cancer Immunotherapy. Russian Journal of Oncology. 2017;22(4):175-179.
Johnston et al., VISTA is an acidic pH-selective ligand for PSGL-1. Nature. Oct. 2019; 574(7779):565-570.
Yarilin, The Principles of Immunology. Meditsina. Chapter 3, pp. 169-174, (1999).

* cited by examiner

*Primary Examiner* — Gary B Nickol
(74) *Attorney, Agent, or Firm* — McCarter & English, LLP; Marcie B. Clarke, Esq.

(57) ABSTRACT

The present disclosure provides antibodies to V-domain Ig-containing Suppressor of T cell Activation (VISTA) and compositions comprising such antibodies. Also provided are methods of using antibodies that specifically binds to VISTA to treat diseases, e.g., to treat cancer.

18 Claims, 93 Drawing Sheets

Specification includes a Sequence Listing.

IFNγ

IFNγ

| | Ab No. 173.1(WT) | Ab No. 420.1(YTE) | Ab No. 289.1(LS) | Ab No. 173.4(WT) | Ab No. 420.4(YTE) | Ab No. 289.4(LS) |
|---|---|---|---|---|---|---|
| EC50 (ug/ml) | 1.554 | 0.05649 | 0.03694 | 1.765 | 0.07294 | 0.04264 |
| EC50 (M) | 10.4nM | 376pM | 246pM | 11.8nM | 486pM | 284pM |

| | Ab No. 150.1 (YTE) | Ab No. 474.1 (WT) | Ab No. 246.4 (WT) | VSTB174 (WT) |
|---|---|---|---|---|
| EC50 (ug/mL) | 0.142 | 0.750 | 0.909 | 1.498 |
| EC50 (nM) | 1.0 | 5.0 | 6.1 | 10.0 |

| | Ab No. 173.1 (WT) | Ab No. 420.1 (YTE) | Ab No. 289.1 (LS) | Ab No. 173.4 (WT) | Ab No. 420.4 (YTE) | Ab No. 289.4 (LS) |
|---|---|---|---|---|---|---|
| EC50 ug/ml | 0.7 | 2.2 | 0.1 | 7.226 | 20.8 | 1.39 |
| EC50 nM | 4.7 | 14.7 | 0.7 | 48 | 139 | 9 |

| | Ab No. 150.1 (YTE) | Ab No. 474.1 (WT) | Ab No. 246.4 (WT) | VSTB174 (WT) |
|---|---|---|---|---|
| EC50 (ug/mL) | 0.868 | 0.228 | 1.457 | 0.534 |
| EC50 (nM) | 5.8 | 1.5 | 9.7 | 3.6 |

| | Ab No. 173.1 (WT) | Ab No. 420.1 (YTE) | Ab No. 289.1 (LS) | Ab No. 173.4 (WT) | Ab No. 420.4 (YTE) | Ab No. 289.4 (LS) |
|---|---|---|---|---|---|---|
| IC50 pg/ml | 97498 | NA | 19232 | NA | NA | NA |
| IC50 nM | 650 | NA | 128 | NA | NA | NA |

| | Ab No. 173.1(WT) | Ab No. 420.1(YTE) | Ab No. 289.1(LS) | Ab No. 173.4(WT) | Ab No. 420.4(YTE) | Ab No. 289.4(LS) |
|---|---|---|---|---|---|---|
| IC50 (pg/ml) | 9089 | 19935 | 2981 | NA | NA | NA |
| IC50 (nM) | 61 | 133 | 20 | NA | NA | NA |

| | Ab No. 150.1 (YTE) | Ab No. 474.1 (WT) | Ab No. 246.4 (WT) | VSTB174 (WT) |
|---|---|---|---|---|
| EC50 (ug/mL) | 41.3 | 9.3 | 29.4 | 4.6 |
| EC50 (nM) | 275 | 62 | 196 | 31 |

| | Ab No. 150.1 (YTE) | Ab No. 474.1 (WT) | Ab No. 246.4 (WT) | VSTB174 (WT) |
|---|---|---|---|---|
| EC50 (ug/mL) | 18.3 | 4.0 | 58.4 | 2.1 |
| EC50 (nM) | 122 | 27 | 389 | 14 |

| | Ab No. 173.1 (WT) | Ab No. 420.1 (YTE) | Ab No. 289.1 (LS) | Ab No. 173.4 (WT) | Ab No. 420.4 (YTE) | Ab No. 289.4 (LS) |
|---|---|---|---|---|---|---|
| EC50 | 9.929 | 52.46 | 17.05 | 84.09 | 28.45 | 127.4 |

| | Ab No. 173.1 (WT) | Ab No. 420.1 (YTE) | Ab No. 289.1 (LS) | Ab No. 173.4 (WT) | Ab No. 420.4 (YTE) | Ab No. 289.4 (LS) |
|---|---|---|---|---|---|---|
| IC50 (ug/ml) | 17.7 | 135.1 | 12.8 | NA | NA | NA |
| IC50 (nM) | 114 | 901 | 85 | NA | NA | NA |

| | Ab No. 150.1 (YTE) | Ab No. 474.1 (WT) | Ab No. 246.4 (WT) | VSTB174 (WT) |
|---|---|---|---|---|
| EC50 (ug/mL) | 53.5 | 7.5 | >250 | 3.5 |
| EC50 (nM) | 357 | 50 | >1667 | 23 |

| | Ab No. 150.1 (YTE) | Ab No. 474.1 (WT) | Ab No. 246.4 (WT) | VSTB174 (WT) |
|---|---|---|---|---|
| EC50 (ug/mL) | 42.5 | 6.5 | >250 | 1.5 |
| EC50 (nM) | 283 | 43 | >1667 | 10 |

Ab No. 150.1 with ascending nM concentrations of FcRn ligand

Ab No. 474.1 with ascending nM concentrations of FcRn ligand

VSTB174 with ascending nM concentrations of FcRn ligand

| EC50 | ng/ml |
|---|---|
| 421.1 | 10.78 |

| EC50 | ng/ml |
|---|---|
| 245.1 | 5.24 |
| 475.1 | 5.75 |

| EC50 | ng/ml |
|---|---|
| 465.1 | 15.7 |

| EC50 | ng/ml |
|---|---|
| 457.1 | 7.936 |

| EC50 | ng/ml |
|---|---|
| 173.1 | 8.5 |
| 420.1 | 15.6 |
| 173.4 | 22.1 |

FIG. 55D
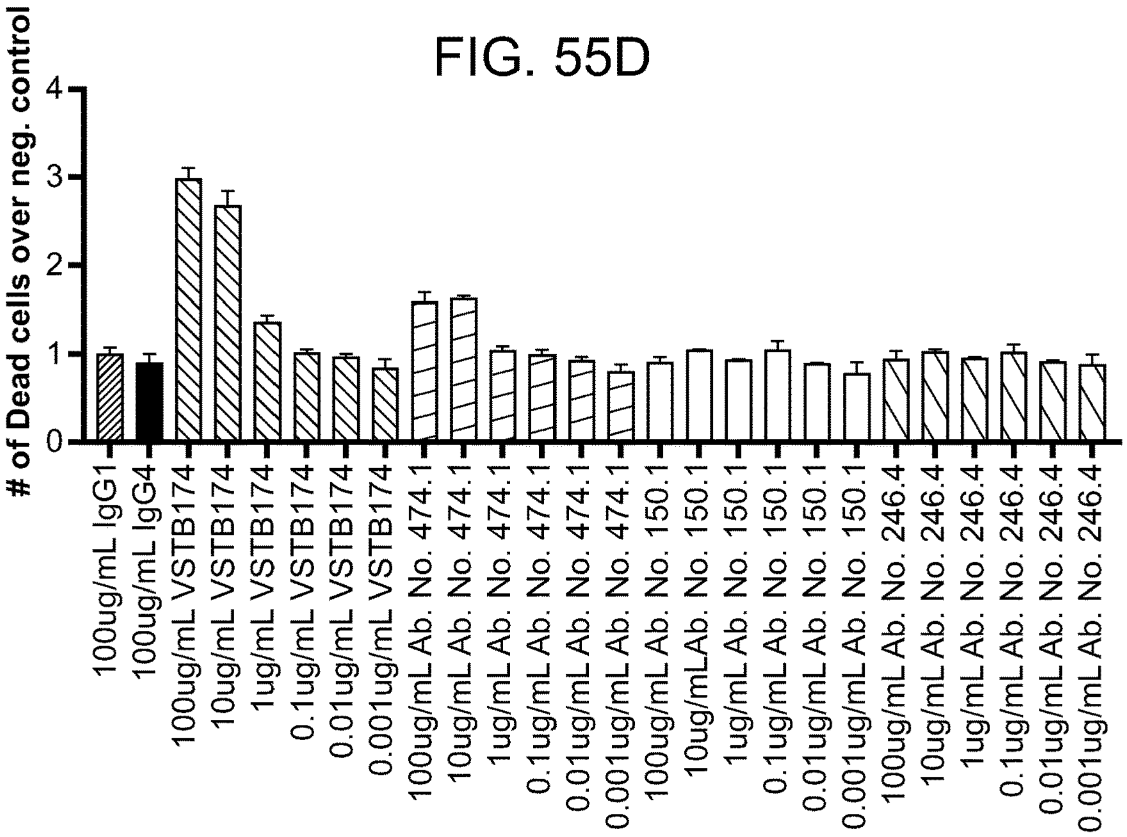
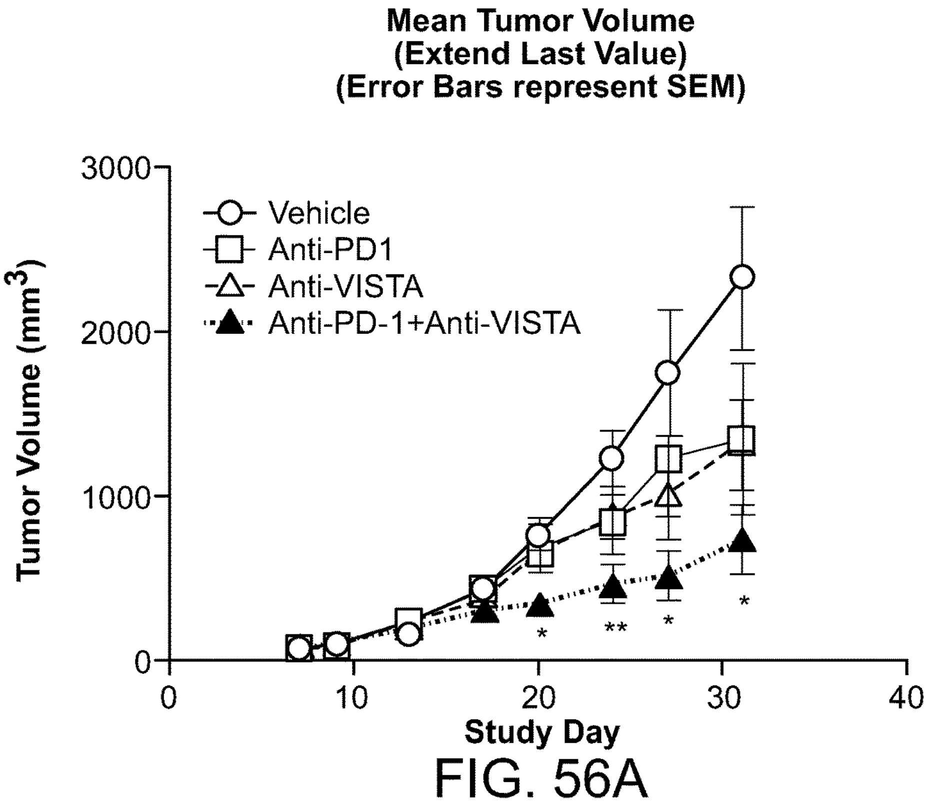
FIG. 56A

Serum Exposure
Ab No. 474.1, Ab No. 150.1 and VSTB174 at 10 mg/kg IP
VISTA KI Female Mice Serum Exposure
Ab No. 150.1 at 10 mg/kg IP
VISTA KI Female Mice Serum Exposure
Ab No. 150.1 at 30 mg/kg IP
VISTA KI Female Mice Mean

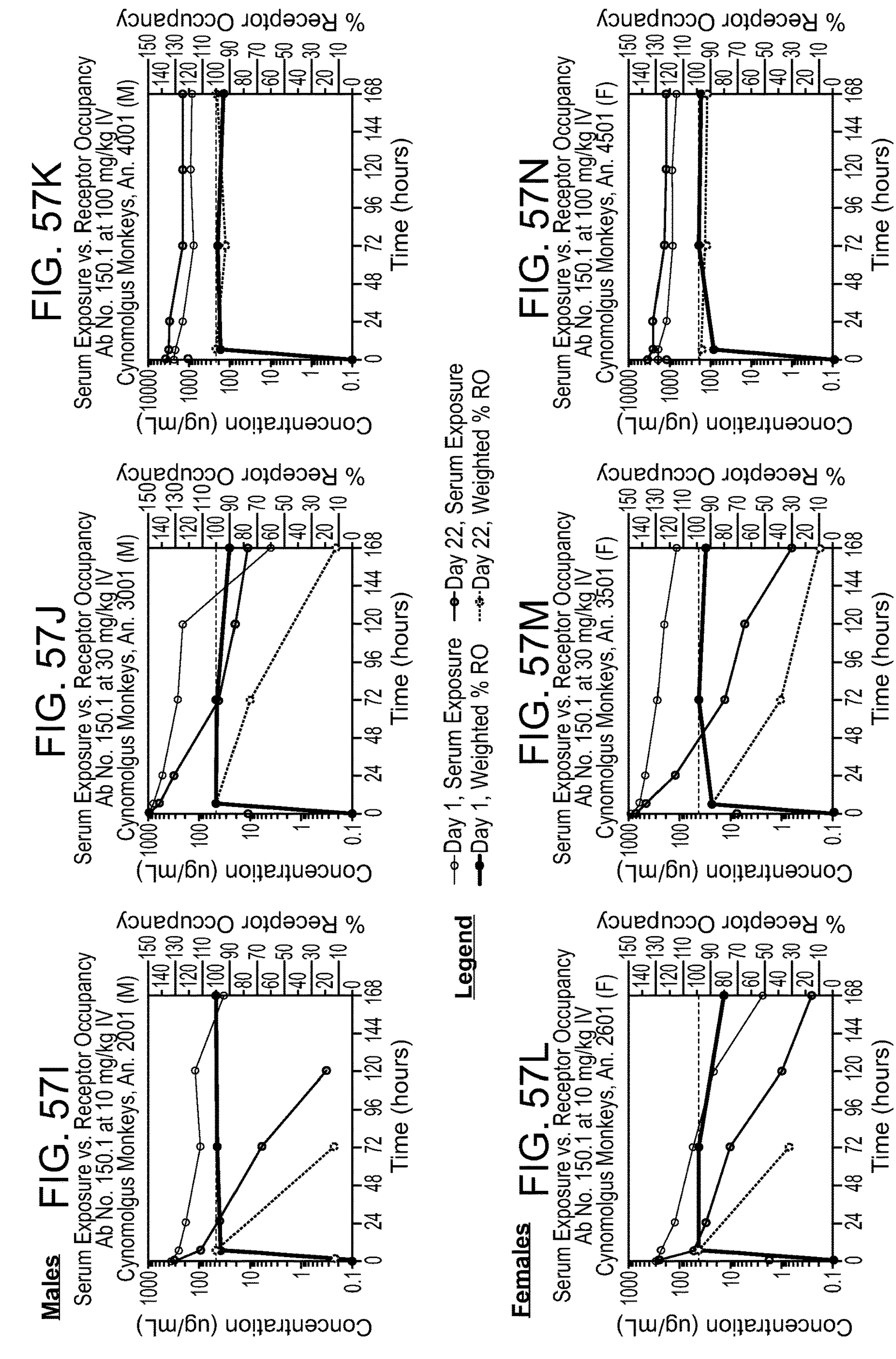
Males
FIG. 57I
Serum Exposure vs. Receptor Occupancy
Ab No. 150.1 at 10 mg/kg IV
Cynomolgus Monkeys, An. 2001 (M)
FIG. 57J
Serum Exposure vs. Receptor Occupancy
Ab No. 150.1 at 30 mg/kg IV
Cynomolgus Monkeys, An. 3001 (M)
FIG. 57K
Serum Exposure vs. Receptor Occupancy
Ab No. 150.1 at 100 mg/kg IV
Cynomolgus Monkeys, An. 4001 (M)
Legend
Day 1, Serum Exposure
Day 1, Weighted % RO
Day 22, Serum Exposure
Day 22, Weighted % RO
Females
FIG. 57L
Serum Exposure vs. Receptor Occupancy
Ab No. 150.1 at 10 mg/kg IV
Cynomolgus Monkeys, An. 2601 (F)
FIG. 57M
Serum Exposure vs. Receptor Occupancy
Ab No. 150.1 at 30 mg/kg IV
Cynomolgus Monkeys, An. 3501 (F)
FIG. 57N
Serum Exposure vs. Receptor Occupancy
Ab No. 150.1 at 100 mg/kg IV
Cynomolgus Monkeys, An. 4501 (F)
Concentration (ug/mL)
% Receptor Occupancy
Time (hours)
0 24 48 72 96 120 144 168

Ab No. 289.1

Ab No. 420.1

CD3+
Freq. of Live CD45+ cells
45
40
35
30
25
20
Mse IgG2a
Ab No. 245.2
Ab No. 245.2 LALA T-cell subtype
Freq. of Live CD45+ cells
30
20
10
0
CD4+
CD8+

NK cells
Freq. of Live CD45+ cells
3
2
1
0
Mse IgG2a
Ab No. 245.2
Ab No. 245.2 LALA gMDSC
Freq of CD11b+ cells
80
60
40
20
0
Mse IgG2a
Ab No. 245.2
Ab No. 245.2 LALA

ANTI-VISTA ANTIBODIES AND USES THEREOF

RELATED APPLICATIONS

This application is a 35 U.S.C. § 371 national stage filing of International Application No. PCT/US2022/016912, filed on Feb. 18, 2022, which in turn claims priority to U.S. Provisional Application No. 63/150,995, filed on Feb. 18, 2021. The entire contents of each of the foregoing applications are expressly incorporated by reference herein.

SEQUENCE LISTING

The instant application contains a Sequence Listing which has been submitted electronically in ASCII format and is hereby incorporated by reference in its entirety. Said ASCII copy, created on Feb. 1, 2022, is named 136589-00120_SL.txt and is 784,935 bytes in size.

FIELD

The present disclosure provides antibodies to V-domain Ig-containing Suppressor of T cell Activation (VISTA) and compositions comprising such antibodies. Also provided are methods of using antibodies that specifically bind to VISTA to treat diseases, e.g., to treat cancer, autoimmune diseases, and infections, e.g., bacterial and fungal infections.

BACKGROUND

VISTA is an immune-suppressive cell surface protein of the B7 family, which exhibits similarity to Programmed Death-Ligand 1 (PD-L1). VISTA functions as both a ligand for antigen-presenting cells and as a receptor for T cells (Böger et al., Oncoimmunology. 2017; 6(4):e1293215 (2017). VISTA is primarily expressed on hematopoietic tissues (e.g., the spleen, thymus and bone marrow) and on myeloid cells, neutrophils, natural killer (NK) cells and regulatory T cells (Tregs) (Wang et al., J. Exp. Med. Vol. 208 No. 3 577-592).

In particular, VISTA is highly expressed on myeloid-derived suppressor cells (MDSC) and Tregs in the tumor microenvironment where it mediates immunosuppression. In particular, VISTA inhibits the T cell response by suppressing T cell receptor activation, leading to cell cycle arrest but not apoptosis (Wang et al., J. Exp. Med. Vol. 208 No. 3 577-592). VISTA is highly expressed in "cold tumors" (tumors that are not infiltrated by T cells), and high VISTA expression is associated with poor survival in cancer patients, e.g., in pancreatic cancer (Blando et al., 2019, Proc Nat Acad Sci. 116(5):1692-97). VISTA expression has been shown to increase in prostate cancer and melanoma after treatment with checkpoint inhibitor therapy, pointing to a potential resistance mechanism (Kakavand et al., 2017, Modern Pathology 30:1666-1676; Gao et al., 2017, Nat Med. May; 23(5): 551-555).

For antibody engineering, the different isotypes and subclasses are important for antibody optimization and function since the sequence variation occurs at sites that determine affinities and specificities for neonatal Fc receptor (FcRn), Fc alpha receptor, Fc gamma receptors, and complement protein C1q (Woof, J. M., and Burton, D. R. Nat. Rev. Immunol. 4 (2004) 89-99). There are 5 Fc gamma receptors (FcγR) that activate effector cells upon binding to IgG. Among the activating receptors there are FcγRI, FcγRIIa, FcγRIIc, FcγRIIIa, and FcγRIIIb (Nimmerjahn, F. and Revetch, J. V. Nat. Rev. Immunol. 8 (2008) 34-47). There is one inhibitory Fc gamma receptor—FcγRIIb. The FcγRs are polymorphic, where certain alleles exhibit higher affinity for Fc than others. Antibody binding to these receptors can facilitate the recruitment of effector cells to opsonized target cells or opsonized pathogens for clearance (Nimmerjahn, F. and Revetch, J. V. Nat. Rev. Immunol. 8 (2008) 34-47). Therefore, changes to the sequence and post-translational modification of the Fe and hinge regions of antibodies allows one to manipulate the effector functions and circulation of a given antibody or antibody-like protein (Presta, L. G. Curr. Opin. Immunol. 20 (2008) 460-470). In addition to sequence variation, the Fc region also contains an N-linked glycosylation site at residue 297, which is important for Fc structure and function (Dwek, R. R. et al. J. Anat. 187 (1995) 279-292). Mutated Fc regions that have reduced binding to Fc gamma receptors and decreased Fc gamma receptor-mediated activities have been described (U.S. Pat. No. 10,053,513 B2).

Antibody elimination occurs mostly through intracellular catabolism by lysosomal degradation to amino acids after uptake by either pinocytosis or by a receptor-mediated endocytosis process (Waldmann, T. A. and Strober, W. Prog. Allergy 13 (1969) 1-110).

Receptor-mediated endocytosis of antibodies results from interaction of cell surface receptors with either the Fc domain or one of the Fab binding domains of the antibody. This binding event triggers endocytotic internalization of the antibody into a vesicle and subsequent lysosomal degradation. When binding is between the antibody Fab and its antigen, the resulting endocytosis and elimination is called target-mediated drug disposition (TMDD) (Mager, D. E. and Jusko, W. J. J. Pharmacokinet. Pharmacodyn. 28 (2001) 507-5320).

The rate of elimination of an antibody through TMDD is dependent on the expression of the antigen receptor target, the affinity of the mAb for the antigen, the dose of the mAb, the rate of receptor-antibody complex internalization and recycling, and the rate of catabolism within the target cell. Antibodies cleared primarily by TMDD will have dose-dependent nonlinear elimination. For antibodies with a plasma membrane expressed target like VISTA, TMDD is a major route of elimination, especially at low doses and concentrations of therapeutic antibody (Ryman, J. T. and Meibohm, B. CPT Pharmacometrics Syst. Pharmacol. 6 (2017) 576-588).

Antibody-receptor complexes on the plasma membrane are internalized into vesicles that fuse with endosomal compartments. The complexes can either be routed to degradation in lysosomes or be recycled intact to the cell surface and extracellular medium. Evidence suggests that the outcome of this sorting decision is related to the antibody-receptor binding affinity, with complexes that remain bound generally becoming degraded and those that dissociate being recycled (Chimalakonda, A. P., et. Al. AAPS J. 15 (2013) 717-727). In general, dissociation of complexes in endosomes enhances antibody recycling. Dissociation of antibody-receptor complexes in the endosome and lysosome can be modulated by pH sensitive interactions.

For most of the investigated pH-sensitive interactions, pH-dependent binding relies on the presence of ionizable histidines ("histidine switches") that mediate structural transitions in binding or folding of the interacting protein (Kulkarni, M. V. at. Al. J. Biol. Chem. 285 (2010) 38524-38533; Maeda, K. et. Al. J. Control. Release 82 (2002) 71-82; Yamamoto, T. et. Al. Biochemistry 47 (2008) 11647-11652). Alterations of electrostatic interactions that are induced upon histidine protonation at lower pH-values can lead to decreased binding affinity, and protein engineering approaches that incorporate pH-sensitivity into proteins typically use strategies of histidine substitution.

The following are examples of the successful engineering of histidine switches in therapeutic proteins to reduce metabolism and improve half-life.

Igawa T., et al. Nat. Biotechnol. 28 (2010) 1203-1207 describes an engineered antibody against the IL-6 receptor (IL-6R) that rapidly dissociates from IL-6R within the acidic environment of the endosome (pH6.0) while maintaining its binding affinity to IL-6R in plasma (pH7.4).

WO2011/111007 discloses antibodies with pH dependent antigen-binding that preferably dissociate from the antigen in the endosome.

Rother et al. Nat. Biotechnol. 25 (2007) 1256-1264 describes the discovery and development of the complement inhibitor eculizumab with histidine switches mediating endosomal escape for the treatment of paroxysmal nocturnal hemoglobinuria.

WO2015/134894A1 describes antibodies that bind to C5 that are engineered to rapidly dissociate from their target at endosomal pH, thereby increasing their half-life.

U.S. Pat. No. 9,540,449 B2 describes antibodies to PCSK9 with improved serum half-life that bind to the cell surface receptor at neutral pH but readily dissociate from the target at acidic pH.

Fallon et al. J. Biol. Chem. 275 (1999) 6790-6797 describe mutants of interleukin 2 that display reduced endocytic degradation due to enhanced ligand recycling. Binding affinity of mutant IL-2 to its receptor is higher at neutral pH than acidic pH allowing for endosomal sorting and recycling of the ligand receptor complex.

Sarkar, C. S., et. Al. Nat. Biotech. 20 (2002) 908-913 describe the use of "histidine switches" to improve cellular trafficking of granulocyte colony stimulating factor.

Anti-VISTA antibodies have been described (see, e.g. U.S. Pat. Nos. 8,231,872, 8,236,304, 8,501,915, and 10,766,959, and U.S. Patent Application Publication No. US 2020/0407449 A1, as well as International Patent Application Publication Nos. WO 2016/207717 A8, WO 2014/197849 A9, WO 2018/169993 A1, WO 2018/237287 A1, WO2019/152810 A1, WO 2019/185879 A1, and WO 2020/016459 A1). However, despite all of the foregoing, a need exists in the art for effective therapeutic antibodies.

Citation of a reference in the present disclosure shall not be construed as an admission that such reference is prior art.

SUMMARY

Anti-VISTA antibodies known prior to the instant disclosure have exhibited numerous shortcomings, including failing to address the fact that multiple ligands bind to the VISTA receptor, the potential for antibody-dependent cellular cytotoxicity (ADCC) of VISTA-expressing immune cells and toxic cytokine release, anti-drug antibody or immunogenicity, multiple binding epitopes on VISTA that have varying efficacy and toxicity, and un-optimized Fc binding. The inventors of the instant application have harnessed the knowledge of these shortcomings to design novel anti-VISTA antibodies, and antigen-binding fragments thereof, which overcome these concerns. Each of these aspects are described in more detail below.

To begin with, most known anti-VISTA antibodies bind to one of two dominant epitopes on the VISTA extracellular domain. The first epitope, R54/F62/Q63, is associated with anti-tumor efficacy, but is also associated with significant cytokine release and inflammation, creating serious safety concerns for therapeutic treatment. The second epitope, H121/H122/H123 convers pH sensitive binding and increased PK, but eliminates most anti-tumor activity. The inventors of the instant application have identified the anti-VISTA antibodies, and antigen-binding fragments thereof, disclosed herein, which bind to a third proprietary epitope, and which exhibit improved safety and excellent single agent efficacy in tumor models (see Examples herein).

Secondly, previously known anti-VISTA antibodies have been shown to block only one, two, or (at most) three of the known VISTA ligands either at pH 6.0 or pH 7.4. In contrast, the anti-VISTA antibodies, and antigen-binding fragments described herein, are able to block the binding of all five known ligands to VISTA over a range of pH's from 6.0 to 7.4, providing increased efficacy.

Additionally, the anti-VISTA antibodies, and antigen-binding fragments thereof, described herein, have been Fc-optimized to provide reduce Fcγ receptor binding and, therefore, reduced ADCC, CDC (complement-dependent cytotoxicity), and proinflammatory cytokine release, providing increased safety for therapeutic administration. Several anti-VISTA antibodies described herein have been further Fc-optimized to increase FcRn binding and, therefore, increase antibody recycling and prolonged exposure. Finally, the anti-VISTA antibodies and antigen-binding fragments described herein were developed using a genetically engineered humanized mouse model, conferring a further advantage related to decreased immunogenicity in humans. Thus, the anti-VISTA antibodies, and antigen-binding fragments thereof, described herein exhibit surprising and improved properties over anti-VISTA antibodies known prior to the instant disclosure, and uses thereof.

Accordingly, in one aspect, disclosed herein is a human anti-VISTA antibody, or an antigen-binding fragment thereof, which (i) blocks the binding of all five known ligands to VISTA (VSIG-3 (V-set and immunoglobulin domain containing 3), VSIG-8 (V-set and immunoglobulin domain containing 8), PSGL-1 (P-selectin glycoprotein ligand-1), LRIG1 (leucine rich repeats and immunoglobulin like domains 1) and VISTA) at pH 6.0 and/or pH 7.4; and/or (ii) binds to a unique epitope including amino acid Tyrosine 37, Arginine 54, Valine 117 and Arginine 127 of VISTA-ECD (extracellular domain).

In one aspect, disclosed herein is an antibody, or an antigen-binding fragment thereof, that binds to V-domain Ig-containing Suppressor of T cell Activation (VISTA), wherein the antibody, or antigen-binding fragment thereof, blocks binding of all five ligands to VISTA at pH 6.0 and pH 7.4, wherein the five known ligands to VISTA are VSIG-3 (V-set and immunoglobulin domain containing 3), VSIG-8 (V-set and immunoglobulin domain containing 8), PSGL-1 (P-selectin glycoprotein ligand-1), LRIG1 (leucine rich repeats and immunoglobulin like domains 1) and VISTA; and wherein the antibody, or antigen-binding fragment thereof, comprises a heavy chain variable region (VH) and a light chain variable region (VL).

In another aspect, disclosed herein is an antibody, or an antigen-binding fragment thereof, that binds to V-domain Ig-containing Suppressor of T cell Activation (VISTA), wherein the antibody, or antigen-binding fragment thereof, comprises a heavy chain variable region (VH) and a light chain variable region (VL), wherein the VH comprises a sequence having at least 90%, 91%, 92%, 93%, 94%, 95%, 96%, 97%, 98%, or 99% identity to, comprises, or consists of any one of SEQ ID NOs: 584-597, 227-246, and 383-386, and wherein the VL comprises a sequence having at least 90%, 91%, 92%, 93%, 94%, 95%, 96%, 97%, 98%, or 99% identity to, comprises, or consists of any one of SEQ ID NOs: 84-110. In one embodiment, the antibody, or antigen-binding fragment thereof, blocks binding of all five ligands to VISTA at pH 6.0 and pH 7.4, wherein the five known ligands to VISTA are VSIG-3 (V-set and immunoglobulin domain containing 3), VSIG-8 (V-set and immunoglobulin domain containing 8), PSGL-1 (P-selectin glycoprotein ligand-1), LRIG1 (leucine rich repeats and immunoglobulin like domains 1) and VISTA. In another embodiment, the antibody, or antigen-binding fragment thereof comprises a VH CDR1 of any one of SEQ ID NOs: 247-253 as defined by Kabat numbering system; any one of SEQ ID NOs: 284-291 as defined by IMGT numbering system; or any one of SEQ ID NOs: 318-325 as defined by Paratome numbering system; a VH CDR2 of any one of SEQ ID NOs: 254-265 as defined by Kabat numbering system; any one of SEQ ID NOs: 292-298 as defined by IMGT numbering system; or any one of SEQ ID NOs: 326-339 as defined by Paratome numbering system; a VH CDR3 of any one of SEQ ID NOs: 266-283 as defined by Kabat numbering system; any one of SEQ ID NOs: 299-317 as defined by IMGT numbering system; or any one of SEQ ID NOs: 340-359 as defined by Paratome numbering system; a VL CDR1 of any one of SEQ ID NOs: 111-122 as defined by Kabat numbering system; any one of SEQ ID NOs: 152-162 as defined by IMGT numbering system; or any one of SEQ ID NOs: 188-196 or 576-578 as defined by Paratome numbering system; a VL CDR2 of any one of SEQ ID NOs: 123-131 and 575 as defined by Kabat numbering system; any one of SEQ ID NOs: 163-167 as defined by IMGT numbering system; or any one of SEQ ID NOs: 197-206 as defined by Paratome numbering system, a VL CDR3 of any one of SEQ ID NOs: 132-151 as defined by Kabat numbering system; any one of SEQ ID NOs: 168-186 as defined by IMGT numbering system; or any one of SEQ ID NOs: 207-226 as defined by Paratome numbering system.

In one aspect, disclosed herein is an antibody, or antigen-binding fragment thereof, that binds to VISTA, wherein the antibody or antigen-binding fragment thereof, comprises a VH and a VL, wherein the VH comprises: a VH CDR1 of any one of SEQ ID NOs: 247-253 as defined by Kabat numbering system; any one of SEQ ID NOs: 284-291 as defined by IMGT numbering system; or any one of SEQ ID NOs: 318-325 as defined by Paratome numbering system, a VH CDR2 of any one of SEQ ID NOs: 254-265 as defined by Kabat numbering system; any one of SEQ ID NOs: 292-298 as defined by IMGT numbering system; or any one of SEQ ID NOs: 326-339 as defined by Paratome numbering system, a VH CDR3 of any one of SEQ ID NOs: 266-283 as defined by Kabat numbering system; any one of SEQ ID NOs: 299-317 as defined by IMGT numbering system; or any one of SEQ ID NOs: 340-359 as defined by Paratome numbering system, and wherein the VL comprises: a VL CDR1 of any one of SEQ ID NOs: 111-122 as defined by Kabat numbering system; any one of SEQ ID NOs: 152-162 as defined by IMGT numbering system; or any one of SEQ ID NOs: 188-196 or 576-578 as defined by Paratome numbering system, a VL CDR2 of any one of SEQ ID NOs: 123-131 and 575 as defined by Kabat numbering system; any one of SEQ ID NOs: 163-167 as defined by IMGT numbering system; or any one of SEQ ID NOs: 197-206 as defined by Paratome numbering system, and a VL CDR3 of any one of SEQ ID NOs: 132-151 as defined by Kabat numbering system; any one of SEQ ID NOs: 168-186 as defined by IMGT numbering system; or any one of SEQ ID NOs: 207-226 as defined by Paratome numbering system. In one embodiment, the antibody, or antigen-binding fragment thereof, blocks binding of all five ligands to VISTA at pH 6.0 and pH 7.4, wherein the five known ligands to VISTA are VSIG-3 (V-set and immunoglobulin domain containing 3), VSIG-8 (V-set and immunoglobulin domain containing 8), PSGL-1 (P-selectin glycoprotein ligand-1), LRIG1 (leucine rich repeats and immunoglobulin like domains 1) and VISTA.

In one embodiment, the VH comprises a sequence having at least 90%, 91%, 92%, 93%, 94%, 95%, 96%, 97%, 98%, or 99% identity to, comprises, or consists of any one of SEQ ID NOs: 584-597, 227-246, and 383-386, and the VL comprises a sequence having at least 90%, 91%, 92%, 93%, 94%, 95%, 96%, 97%, 98%, or 99% identity to, comprises, or consists of any one of SEQ ID NOs: 84-110.

In another embodiment, the VH CDR1 comprises SEQ ID NO: 247, the VH CDR2 comprises SEQ ID NO: 254, the VH CDR3 comprises SEQ ID NO: 266, the VL CDR1 comprises SEQ ID NO: 111, the VL CDR2 comprises SEQ ID NO: 123, and the VL CDR3 comprises SEQ ID NO: 132; the VH CDR1 comprises SEQ ID NO: 284, the VH CDR2 comprises SEQ ID NO: 292, the VH CDR3 comprises SEQ ID NO: 299, the VL CDR1 comprises SEQ ID NO: 152, the VL CDR2 comprises SEQ ID NO: 163, and the VL CDR3 comprises SEQ ID NO: 168; the VH CDR1 comprises SEQ ID NO: 318, the VH CDR2 comprises SEQ ID NO: 326, the VH CDR3 comprises SEQ ID NO: 340, the VL CDR1 comprises SEQ ID NO: 188, the VL CDR2 comprises SEQ ID NO: 197, and the VL CDR3 comprises SEQ ID NO: 207; the VH CDR1 comprises SEQ ID NO: 248, the VH CDR2 comprises SEQ ID NO: 255, the VH CDR3 comprises SEQ ID NO: 267, the VL CDR1 comprises SEQ ID NO: 112, the VL CDR2 comprises SEQ ID NO: 124, and the VL CDR3 comprises SEQ ID NO: 133; the VH CDR1 comprises SEQ ID NO: 285, the VH CDR2 comprises SEQ ID NO: 293, the VH CDR3 comprises SEQ ID NO: 300, and the VL CDR1 comprises SEQ ID NO: 153, the VL CDR2 comprises SEQ ID NO: 164 and the VL CDR3 comprises SEQ ID NO: 169; the VH CDR1 comprises SEQ ID NO: 319, the VH CDR2 comprises SEQ ID NO: 327, the VH CDR3 comprises SEQ ID NO: 341, and the VL CDR1 comprises SEQ ID NO: 189, the VL CDR2 comprises SEQ ID NO: 198, and the VL CDR3 comprises SEQ ID NO: 208; the VH CDR1 comprises SEQ ID NO: 249, the VH CDR2 comprises SEQ ID NO: 256, the VH CDR3 comprises SEQ ID NO: 268, the VL CDR1 comprises SEQ ID NO: 113, the VL CDR2 comprises SEQ ID NO: 125, and the VL CDR3 comprises SEQ ID NO: 134; the VH CDR1 comprises SEQ ID NO: 286, the VH CDR2 comprises SEQ ID NO: 294, the VH CDR3 comprises SEQ ID NO: 301, the VL CDR1 comprises SEQ ID NO: 154, the VL CDR2 comprises SEQ ID NO: 165, and the VL CDR3 comprises SEQ ID NO: 170; the VH CDR1 comprises SEQ ID NO: 320, the VH CDR2 comprises SEQ ID NO: 328, the VH CDR3 comprises SEQ ID NO: 342, the VL CDR1 comprises SEQ ID NO: 190, the VL CDR2 comprises SEQ ID NO: 199, and the VL CDR3 comprises SEQ ID NO: 209; the VH CDR1 comprises SEQ ID NO: 250, the VH CDR2 comprises SEQ ID NO: 257, the VH CDR3 comprises SEQ ID NO: 269, the VL CDR1 comprises SEQ ID NO: 114, the VL CDR2 comprises SEQ ID NO: 126, and the VL CDR3 comprises SEQ ID NO: 135; the VH CDR1 comprises SEQ ID NO: 287, the VH CDR2 comprises SEQ ID NO: 295, the VH CDR3 comprises SEQ ID NO: 302, the VL CDR1 comprises SEQ ID NO: 155, the VL CDR2 comprises SEQ ID NO: 165, and the VL CDR3 comprises SEQ ID NO: 171; the VH CDR1 comprises SEQ ID NO: 321, the VH CDR2 comprises SEQ ID NO: 329, the VH CDR3 comprises SEQ ID NO: 343, the VL CDR1 comprises SEQ ID NO: 191, the VL CDR2 comprises SEQ ID NO: 200, and the VL CDR3 comprises SEQ ID NO: 210; the VH CDR1 comprises SEQ ID NO: 251, the VH CDR2 comprises SEQ ID NO: 258, the VH CDR3 comprises SEQ ID NO: 270, the VL CDR1 comprises SEQ ID NO: 115, the VL CDR2 comprises SEQ ID NO: 127, and the VL CDR3 comprises SEQ ID NO: 136; the VH CDR1 comprises SEQ ID NO: 288, the VH CDR2 comprises SEQ ID NO: 295, the VH CDR3 comprises SEQ ID NO: 303, the VL CDR1 comprises SEQ ID NO: 156, the VL CDR2 comprises SEQ ID NO: 166, and the VL CDR3 comprises SEQ ID NO: 172; the VH CDR1 comprises SEQ ID NO: 322, the VH CDR2 comprises SEQ ID NO: 330, the VH CDR3 comprises SEQ ID NO: 344, the VL CDR1 comprises SEQ ID NO: 192, the VL CDR2 comprises SEQ ID NO: 201, and the VL CDR3 comprises SEQ ID NO: 211; the VH CDR1 comprises SEQ ID NO: 248, the VH CDR2 comprises SEQ ID NO: 259, the VH CDR3 comprises SEQ ID NO: 271, the VL CDR1 comprises SEQ ID NO: 116, the VL CDR2 comprises SEQ ID NO: 126, and the VL CDR3 comprises SEQ ID NO: 137; the VH CDR1 comprises SEQ ID NO: 285, the VH CDR2 comprises SEQ ID NO: 296, the VH CDR3 comprises SEQ ID NO: 304, the VL CDR1 comprises SEQ ID NO: 157, the VL CDR2 comprises SEQ ID NO: 165, and the VL CDR3 comprises SEQ ID NO: 173; or the VH CDR1 comprises SEQ ID NO: 319, the VH CDR2 comprises SEQ ID NO: 331, the VH CDR3 comprises SEQ ID NO: 345, the VL CDR1 comprises SEQ ID NO: 193, the VL CDR2 comprises SEQ ID NO: 200, and the VL CDR3 comprises SEQ ID NO: 212.

In another embodiment, the VH CDR1 comprises SEQ ID NO: 247, SEQ ID NO: 284 or SEQ ID NO: 318, the VH CDR2 comprises SEQ ID NO: 254, SEQ ID NO: 292 or SEQ ID NO: 326, the VH CDR3 comprises SEQ ID NO: 266, SEQ ID NO: 299 or SEQ ID NO: 340, the VL CDR1 comprises SEQ ID NO: 111, SEQ ID NO: 152 or SEQ ID NO 188, the VL CDR2 comprises SEQ ID NO: 123, SEQ ID NO: 163 or SEQ ID NO: 197, and the VL CDR3 comprises SEQ ID NO: 132, SEQ ID NO: 168 or SEQ ID NO: 207; the VH CDR1 comprises SEQ ID NO: 248, SEQ ID NO: 285 or SEQ ID NO: 319, the VH CDR2 comprises SEQ ID NO: 255, SEQ ID NO: 293 or SEQ ID NO:327, the VH CDR3 comprises SEQ ID NO: 267, SEQ ID NO: 300 or SEQ ID NO:341, the VL CDR1 comprises SEQ ID NO: 112, SEQ ID NO: 153 or SEQ ID NO: 189, the VL CDR2 comprises SEQ ID NO: 124, SEQ ID NO: 164 or SEQ ID NO: 198, and the VL CDR3 comprises SEQ ID NO: 133, SEQ ID NO: 169 or SEQ ID NO: 208; the VH CDR1 comprises SEQ ID NO: 249, SEQ ID NO: 286 or SEQ ID NO: 320, the VH CDR2 comprises SEQ ID NO: 256, SEQ ID NO: 294 or SEQ ID NO: 328, the VH CDR3 comprises SEQ ID NO: 268, SEQ ID NO: 301 or SEQ ID NO: 342, the VL CDR1 comprises SEQ ID NO: 113, SEQ ID NO: 154 or SEQ ID NO: 190, the VL CDR2 comprises SEQ ID NO: 125, SEQ ID NO: 165, or SEQ ID NO: 199, and the VL CDR3 comprises SEQ ID NO: 134, SEQ ID NO: 170 or SEQ ID NO: 209; the VH1 CDR1 comprises SEQ ID NO: 250, SEQ ID NO: 287, or SEQ ID NO: 321, the VH CDR2 comprises SEQ ID NO: 257, SEQ ID NO: 295 or SEQ ID NO: 332, the VH CDR3 comprises SEQ ID NO: 269, SEQ ID NO 302: or SEQ ID NO: 346, the 195, the VL CDR1 comprises SEQ ID NO: 114, SEQ ID NO: 155 or SEQ ID NO: 191, the VL CDR2 comprises SEQ ID NO: 126, SEQ ID NO: 165 or SEQ ID NO: 200, and the VL CDR3 comprises SEQ ID NO: 135, SEQ ID NO: 171 or SEQ ID NO: 210; the VH CDR1 comprises SEQ ID NO: 251, SEQ ID NO: 288 or SEQ ID NO: 322, the VH CDR2 comprises SEQ ID NO: 258, SEQ ID NO: 295 or SEQ ID NO: 333, the VH CDR3 comprises SEQ ID NO: 270, SEQ ID NO: 303 or SEQ ID NO: 344, the VL CDR1 comprises SEQ ID NO: 115, SEQ ID NO: 156 or SEQ ID NO: 192, the VL CDR2 comprises SEQ ID NO: 127, SEQ ID NO: 166 or SEQ ID NO: 201, and the VL CDR3 comprises SEQ ID NO: 136, SEQ ID NO: 172 or SEQ ID NO: 211; or the VH CDR1 comprises SEQ ID NO: 248, SEQ ID NO: 185 or SEQ ID NO: 319, the VH CDR2 comprises SEQ ID NO: 259, SEQ ID NO: 296 or SEQ ID NO: 331, the VH CDR3 comprises SEQ ID NO: 271, SEQ ID NO: 304 or SEQ ID NO: 345, the VL CDR1 comprises SEQ ID NO: 116, SEQ ID NO: 157 or SEQ ID NO: 193, the VL CDR2 comprises SEQ ID NO: 126, SEQ ID NO: 165 or SEQ ID NO: 200, and the VL CDR3 comprises SEQ ID NO: 137, SEQ ID NO: 173 or SEQ ID NO: 212.

In another embodiment, (i) the VH comprises a sequence having at least 90%, 91%, 92%, 93%, 94%, 95%, 96%, 97%, 98%, or 99% identity to, comprises, or consists of SEQ ID NO: 592, and the VL comprises a sequence having at least 90%, 91%, 92%, 93%, 94%, 95%, 96%, 97%, 98%, or 99% identity to, comprises, or consists of SEQ ID NO: 86; (ii) the VH comprises a sequence having at least 90%, 91%, 92%, 93%, 94%, 95%, 96%, 97%, 98%, or 99% identity to, comprises, or consists of SEQ ID NO: 584, and the VL comprises a sequence having at least 90%, 91%, 92%, 93%, 94%, 95%, 96%, 97%, 98%, or 99% identity to, comprises, or consists of SEQ ID NO: 84; (iii) the VH comprises a sequence having at least 90%, 91%, 92%, 93%, 94%, 95%, 96%, 97%, 98%, or 99% identity to, comprises, or consists of SEQ ID NO: 585, and the VL comprises a sequence having at least 90%, 91%, 92%, 93%, 94%, 95%, 96%, 97%, 98%, or 99% identity to, comprises, or consists of SEQ ID NO: 85; (iv) the VH comprises a sequence having at least 90%, 91%, 92%, 93%, 94%, 95%, 96%, 97%, 98%, or 99% identity to, comprises, or consists of SEQ ID NO: 586, and the VL comprises a sequence having at least 90%, 91%, 92%, 93%, 94%, 95%, 96%, 97%, 98%, or 99% identity to, comprises, or consists of SEQ ID NO: 86; (v) the VH comprises a sequence having at least 90%, 91%, 92%, 93%, 94%, 95%, 96%, 97%, 98%, or 99% identity to, comprises, or consists of SEQ ID NO: 587, and the VL comprises a sequence having at least 90%, 91%, 92%, 93%, 94%, 95%, 96%, 97%, 98%, or 99% identity to, comprises, or consists of SEQ ID NO: 87; (vi) the VH comprises a sequence having at least 90%, 91%, 92%, 93%, 94%, 95%, 96%, 97%, 98%, or 99% identity to, comprises, or consists of SEQ ID NO: 588, and the VL comprises a sequence having at least 90%, 91%, 92%, 93%, 94%, 95%, 96%, 97%, 98%, or 99% identity to, comprises, or consists of SEQ ID NO: 88; (vii) the VH comprises a sequence having at least 90%, 91%, 92%, 93%, 94%, 95%, 96%, 97%, 98%, or 99% identity to, comprises, or consists of SEQ ID NO: 589, and the VL comprises a sequence having at least 90%, 91%, 92%, 93%, 94%, 95%, 96%, 97%, 98%, or 99% identity to, comprises, or consists of SEQ ID NO: 89; (viii) the VH comprises a sequence having at least 90%, 91%, 92%, 93%, 94%, 95%, 96%, 97%, 98%, or 99% identity to, comprises, or consists of SEQ ID NO: 238, and the VL comprises a sequence having at least 90%, 91%, 92%, 93%, 94%, 95%, 96%, 97%, 98%, or 99% identity to, comprises, or consists of SEQ ID NO: 84; (ix) the VH comprises a sequence having at least 90%, 91%, 92%, 93%, 94%, 95%, 96%, 97%, 98%, or 99% identity to, comprises, or consists of SEQ ID NO: 590, and the VL comprises a sequence having at least 90%, 91%, 92%, 93%, 94%, 95%, 96%, 97%, 98%, or 99% identity to, comprises, or consists of SEQ ID NO: 84; (x) the VH comprises a sequence having at least 90%, 91%, 92%, 93%, 94%, 95%, 96%, 97%, 98%, or 99% identity to, comprises, or consists of SEQ ID NO: 591238, and the VL comprises a sequence having at least 90%, 91%, 92%, 93%, 94%, 95%, 96%, 97%, 98%, or 99% identity to, comprises, or consists of SEQ ID NO: 85; (xi) the VH comprises a sequence having at least 90%, 91%, 92%, 93%, 94%, 95%, 96%, 97%, 98%, or 99% identity to, comprises, or consists of SEQ ID NO: 593, and the VL comprises a sequence having at least 90%, 91%, 92%, 93%, 94%, 95%, 96%, 97%, 98%, or 99% identity to, comprises, or consists of SEQ ID NO: 86; (xii) the VH comprises a sequence having at least 90%, 91%, 92%, 93%, 94%, 95%, 96%, 97%, 98%, or 99% identity to, comprises, or consists of SEQ ID NO: 593238, and the VL comprises a sequence having at least 90%, 91%, 92%, 93%, 94%, 95%, 96%, 97%, 98%, or 99% identity to, comprises, or consists of SEQ ID NO: 87; (xiii) the VH comprises a sequence having at least 90%, 91%, 92%, 93%, 94%, 95%, 96%, 97%, 98%, or 99% identity to, comprises, or consists of SEQ ID NO: 594, and the VL comprises a sequence having at least 90%, 91%, 92%, 93%, 94%, 95%, 96%, 97%, 98%, or 99% identity to, comprises, or consists of SEQ ID NO: 884; or (xiv) the VH comprises a sequence having at least 90%, 91%, 92%, 93%, 94%, 95%, 96%, 97%, 98%, or 99% identity to, comprises, or consists of SEQ ID NO: 595, and the VL comprises a sequence having at least 90%, 91%, 92%, 93%, 94%, 95%, 96%, 97%, 98%, or 99% identity to, comprises, or consists of SEQ ID NO: 89.

In one embodiment, the antibody, or antigen-binding fragment thereof, comprises a heavy chain (HC) sequence having at least 90%, 91%, 92%, 93%, 94%, 95%, 96%, 97%, 98%, or 99% identity to, comprises, or consists of any one of SEQ ID NOs: 407-477, 572-574, and 604-609, and a light chain (LC) sequence having at least 90%, 91%, 92%, 93%, 94%, 95%, 96%, 97%, 98%, or 99% identity to, comprises, or consists of any one of SEQ ID NOs: 387-406, 569-571, and 598-603.

In one embodiment, the antibody, or antigen-binding fragment thereof, binds to human VISTA (amino acids 33-311 of SEQ ID NO:377). In one embodiment, the antibody, or antigen-binding fragment thereof, specifically binds to human VISTA (amino acids 33-311 of SEQ ID NO:377). In one embodiment, the antibody, or antigen-binding fragment thereof, binds to an epitope of human VISTA comprising the amino acid sequence HLHHG (amino acids 98-102 of SEQ ID NO: 377) or VVEIRHHHSEHR (amino acids 148-159 of SEQ ID NO: 377). In one embodiment, the antibody, or antigen-binding fragment thereof, binds to an epitope of human VISTA comprising Tyrosine 37, Arginine 54, Valine 117 and Arginine 127 of SEQ ID NO:377.

In one embodiment, the antibody, or antigen-binding fragment thereof, comprises an Fc region. In one embodiment, the Fe region is a human Fe region or a variant of the human Fc region that has in the range of one to seven amino acid mutations in the Fe region relative to the native human Fe region. In one embodiment, the human Fc region is of a human IgG1, human IgG2 or a human IgG4. In another embodiment, the antibody comprises a constant region of a human IgG1 or a human IgG4 or a variant of the constant region that has in the range of one to seven amino acid mutations in the constant region relative to the native constant region.

In one embodiment, (a) the Fe region is of a human IgG1, and wherein the mutations are selected from the group consisting of C220D, D221C, E233P, L234A, L234E, L234Y, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, E318A, K322A, S324T, K326A, K326M, L328R, P329A, P329G, A330L, A330S, P331A, P331S, 1332E, E333A, E333S, K334A, A378V, S383N, M428L, N434S, and N434Y, wherein the residues are numbered using the EU numbering system; (b) the Fe region is of a human IgG2, and wherein the mutations are selected from the group consisting of C220D, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, A330L, A330S, P331A, P331S, I332E, E333A, E333S, K334A, S383N, M428L, N434S, and N434Y, wherein the residues are numbered using the EU numbering system; or (c) the Fc region is of a human IgG4, and wherein the mutations are selected from the group consisting of S228P, E233P, F234A, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, 1332E, E333A, E333S, K334A, A378V, S383N, M428L, N434S, and N434Y, wherein the residues are numbered using the EU numbering system.

In one embodiment, the antibody, or antigen-binding fragment thereof, is a bispecific antibody or a multispecific antibody. In one embodiment, the antigen-binding fragment is an Fv fragment, a Fab fragment, a F(ab')2 fragment, or a single-chain Fv (scFv).

In one aspect, disclosed herein is an antibody, or antigen-binding fragment thereof, which competes for binding to human VISTA (SEQ ID NO: 377) with any one of the antibodies, or antigen-binding fragments thereof, described herein. In one aspect, disclosed herein is an antibody, or antigen-binding fragment thereof, which prevents binding of any one of the antibodies, or antigen-binding fragments thereof, described herein with human VISTA (SEQ ID NO: 377). In one embodiment, the binding is measured by an ELISA assay, surface plasmon resonance, or BLI, e.g., BLI on the Octet Red 96 (ForteBio System).

In another aspect, disclosed herein is an antibody-drug conjugate comprising an antibody, or antigen-binding fragment thereof, disclosed herein and a therapeutic agent. In another aspect, disclosed herein is a chimeric antigen receptor (CAR) comprising an scFv disclosed herein.

In another aspect, disclosed herein is a polynucleotide comprising a nucleotide sequence encoding the VH of an antibody, or antigen-binding fragment disclosed herein. In another aspect, disclosed herein is a polynucleotide comprising a nucleotide sequence encoding the VL of an antibody, or antigen-binding fragment disclosed herein. In another aspect, disclosed herein is a polynucleotide comprising a nucleotide sequence encoding the VH and the VL of an antibody, or antigen-binding fragment disclosed herein.

In one aspect, disclosed herein is a cell comprising one or more polynucleotides encoding an antibody, or antigen-binding fragment thereof, disclosed herein.

In one aspect, disclosed herein is a pharmaceutical composition comprising an antibody, or antigen-binding fragment thereof, an antibody-drug conjugate, or a CAR disclosed herein, and a pharmaceutically acceptable carrier.

In one aspect, disclosed herein is a method of producing an antibody, or antigen-binding fragment thereof, disclosed herein, the method comprising culturing a cell under conditions such that said one or more polynucleotides are expressed by the cell to produce the antibody, or antigen-binding fragment thereof, encoded by the polynucleotides.

In one aspect, disclosed herein is a method of treating cancer, an autoimmune disease, and/or an infection in a subject in need thereof, comprising administering to the subject a pharmaceutical composition disclosed herein. In one embodiment, the method is for treating cancer. In one embodiment, the method is for treating an autoimmune disease. In one embodiment, the method is for treating an infection. In one embodiment, the cancer is a non-small cell lung cancer, small cell lung cancer, a head and neck squamous cell carcinoma, an hepatocellular carcinoma, an ovarian cancer, a neuroblastoma, an oral cancer, a thyroid cancer, a breast cancer, a sarcoma, a pancreatic cancer, a colon cancer, a gastric cancer, a choriocarcinoma, a testicular cancer, a mesothelioma, a skin cancer, a renal cell carcinoma, a bladder cancer, a hematological cancer, or a cervical cancer. In one embodiment, the cancer is a metastatic cancer. In one embodiment, the cancer is a blood cancer, an acute myeloid leukemia, or a myelodysplastic syndrome. In one embodiment, the method further comprises administering to the subject an additional therapy, optionally wherein the additional therapy is radiotherapy, a chemotherapeutic agent, a targeted therapy, a tyrosine kinase inhibitor, hormone therapy, and/or an immune checkpoint inhibitor. In one embodiment, the immune checkpoint inhibitor is an inhibitor of Programmed Death-1 (PD-1), or Programmed death-ligand 1 (PDL1), or cytotoxic T-lymphocyte-associated protein 4 (CTLA-4).

In one aspect, provided herein is an antibody or an antigen-binding fragment thereof that binds, e.g., specifically binds, to VISTA, wherein the antibody comprises a variable heavy chain region (VH) and a variable light chain region (VL). In one embodiment, the VH comprises (i) a VH complementarity determining region (CDR) 1 of SEQ ID NO: 247, a VH CDR2 of SEQ ID NO: 254, and a VH CDR3 of SEQ ID NO: 266; (ii) a VH CDR 1 of SEQ ID NO: 284, a VH CDR2 of SEQ ID NO: 292, and a VH CDR3 of SEQ ID NO: 299; or (iii) a VH CDR1 of SEQ ID NO: 318, a VH CDR2 of SEQ ID NO: 326, and a VH CDR3 of SEQ ID NO: 340.

In another aspect, provided herein is an antibody or an antigen-binding fragment thereof that specifically binds to VISTA, wherein the antibody comprises a VH and a VL, wherein the VH comprises (i) a VH CDR1 of SEQ ID NO: 248 a VH CDR2 of SEQ ID NO: 255, and a VH CDR3 of SEQ ID NO: 267; (ii) a VH CDR1 of SEQ ID NO: 285, a VH CDR2 of SEQ ID NO: 293, and a VH CDR3 of SEQ ID NO: 300; or (iii) a VH CDR1 of SEQ ID NO: 319, a VH CDR2 of SEQ ID NO: 327, and a VH CDR3 of SEQ ID NO: 341.

In another aspect, provided herein is an antibody or an antigen-binding fragment thereof that specifically binds to VISTA, wherein the antibody comprises a VH and a VL, wherein the VH comprises (i) a VH CDR1 of SEQ ID NO: 249, a VH CDR2 of SEQ ID NO: 256, and a VH CDR3 of SEQ ID NO: 268; (ii) a VH CDR 1 of SEQ ID NO: 286 a VH CDR2 of SEQ ID NO: 294, and a VH CDR3 of SEQ ID NO: 301; or (iii) a VH CDR 1 of SEQ ID NO: 320, a VH CDR2 of SEQ ID NO: 328, and a VH CDR3 of SEQ ID NO: 342.

In another aspect, provided herein is an antibody or an antigen-binding fragment thereof that specifically binds to VISTA, wherein the antibody comprises a VH and a VL, wherein the VH comprises (i) a VH CDR1 of SEQ ID NO: 250, a VH CDR2 of SEQ ID NO: 257, and a VH CDR3 of SEQ ID NO: 269; (ii) a VH CDR1 of SEQ ID NO: 287, a VH CDR2 of SEQ ID NO: 295, and a VH CDR3 of SEQ ID NO: 302; or (iii) a VH CDR1 of SEQ ID NO: 321, a VH CDR2 of SEQ ID NO: 329, and a VH CDR3 of SEQ ID NO: 343.

In another aspect, provided herein is an antibody or an antigen-binding fragment thereof that specifically binds to VISTA, wherein the antibody comprises a VH and a VL, wherein the VH comprises (i) a VH CDR1 of SEQ ID NO: 251, a VH CDR2 of SEQ ID NO: 258, and a VH CDR3 of SEQ ID NO: 270; (ii) a VH CDR1 of SEQ ID NO: 288, a VH CDR2 of SEQ ID NO: 295, and a VH CDR3 of SEQ ID NO: 303; or (iii) a VH CDR1 of SEQ ID NO: 322, a VH CDR2 of SEQ ID NO: 330, and a VH CDR3 of SEQ ID NO: 344.

In another aspect, provided herein is an antibody or an antigen-binding fragment thereof that specifically binds to VISTA, wherein the antibody comprises a VH and a VL, wherein the VH comprises (i) a VH CDR1 of SEQ ID NO: 248, a VH CDR2 of SEQ ID NO: 259, and a VH CDR3 of SEQ ID NO: 271; (ii) a VH CDR1 of SEQ ID NO: 285, a VH CDR2 of SEQ ID NO: 296, and a VH CDR3 of SEQ ID NO: 304; or (iii) a VH CDR1 of SEQ ID NO: 319, a VH CDR2 of SEQ ID NO: 331, and a VH CDR3 of SEQ ID NO: 345.

In another aspect, provided herein is an antibody or an antigen-binding fragment thereof that specifically binds to VISTA, wherein the antibody comprises a VH and a VL, wherein the VH comprises (i) a VH CDR1 of SEQ ID NO: 247, a VH CDR2 of SEQ ID NO: 254, and a VH CDR3 of SEQ ID NO: 277; (ii) a VH CDR1 of SEQ ID NO: 284, a VH CDR2 of SEQ ID NO: 292, and a VH CDR3 of SEQ ID NO: 310; or (iii) a CDR1 of SEQ ID NO: 318, a CDR2 of SEQ ID NO: 326, and a CDR3 of SEQ ID NO: 352.

In another aspect, provided herein is an antibody or an antigen-binding fragment thereof that specifically binds to VISTA, wherein the antibody comprises a VH and a VL, wherein (i) the VH comprises a VH CDR1 of SEQ ID NO: 247, a VH CDR2 of SEQ ID NO: 254, and a VH CDR3 of SEQ ID NO: 266, and the VL comprises a VL CDR1 of SEQ ID NO: 111, a VL CDR2 of SEQ ID NO: 123, and a VL CDR3 of SEQ ID NO: 132; (ii) the VH comprises a VH CDR1 of SEQ ID NO: 284, a VH CDR2 of SEQ ID NO: 292, and a VH CDR3 of SEQ ID NO: 299, and the VL comprises a VL CDR1 of SEQ ID NO: 152, a VL CDR2 of SEQ ID NO: 163, and a VL CDR3 of SEQ ID NO: 168; or (iii) the VH comprises a VH CDR1 of SEQ ID NO: 318, a VH CDR2 of SEQ ID NO: 326, and a VH CDR3 of SEQ ID NO: 340, and the VL comprises a VL CDR1 of SEQ ID NO: 188, a VL CDR2 of SEQ ID NO: 197, and a VL CDR3 of SEQ ID NO: 207.

In another aspect, provided herein is an antibody or an antigen-binding fragment thereof that specifically binds to VISTA, wherein the antibody comprises a VH and a VL, wherein (i) the VH comprises a VH CDR1 of SEQ ID NO: 248, a VH CDR2 of SEQ ID NO: 255, and a VH CDR3 of SEQ ID NO: 267, and the VL comprises a VL CDR 1 of SEQ ID NO: 112, a VL CDR2 of SEQ ID NO: 124, and a VL CDR3 of SEQ ID NO: 133; (ii) the VH comprises a VH CDR1 of SEQ ID NO: 285, a VH CDR2 of SEQ ID NO: 293, and a VH CDR3 of SEQ ID NO: 300, and the VL comprises a VL CDR 1 of SEQ ID NO: 153, a VL CDR2 of SEQ ID NO: 164 and a VL CDR3 of SEQ ID NO: 169; or (iii) the VH comprises a VH CDR1 of SEQ ID NO: 319, a VH CDR2 of SEQ ID NO: 327, and a VH CDR3 of SEQ ID NO: 341, and the VL comprises a VL CDR 1 of SEQ ID NO: 189, a VL CDR2 of SEQ ID NO: 198, and a VL CDR3 of SEQ ID NO: 208.

In another aspect, provided herein is an antibody or an antigen-binding fragment thereof that specifically binds to VISTA, wherein the antibody comprises a VH and a VL, wherein (i) the VH comprises a VH CDR1 of SEQ ID NO: 249, a VH CDR2 of SEQ ID NO: 256, and a VH CDR3 of SEQ ID NO: 268, and the VL comprises a VL CDR1 of SEQ ID NO: 113, a VL CDR2 of SEQ ID NO: 125, and a VL CDR3 of SEQ ID NO: 134; (ii) the VH comprises a VH CDR1 of SEQ ID NO: 286, a VH CDR2 of SEQ ID NO: 294, and a VH CDR3 of SEQ ID NO: 301, and the VL comprises a VL CDR1 of SEQ ID NO: 154, a VL CDR2 of SEQ ID NO: 165, and a VL CDR3 of SEQ ID NO: 170; or (iii) the VH comprises a VH CDR1 of SEQ ID NO: 320, a VH CDR2 of SEQ ID NO: 328, and a VH CDR3 of SEQ ID NO: 342, and the VL comprises a VL CDR1 of SEQ ID NO: 190, a VL CDR2 of SEQ ID NO: 199, and a VL CDR3 of SEQ ID NO: 209.

In another aspect, provided herein is an antibody or an antigen-binding fragment thereof that specifically binds to VISTA, wherein the antibody comprises a VH and a VL, wherein (i) the VH comprises a VH CDR1 of SEQ ID NO: 250, a VH CDR2 of SEQ ID NO: 257, and a VH CDR3 of SEQ ID NO: 269, and the VL comprises a VL CDR1 of SEQ ID NO: 114, a VL CDR2 of SEQ ID NO: 126, and a VL CDR3 of SEQ ID NO: 135; (ii) the VH comprises a VH CDR1 of SEQ ID NO: 287, a VH CDR2 of SEQ ID NO: 295, and a VH CDR3 of SEQ ID NO: 302, and the VL comprises a VL CDR1 of SEQ ID NO: 155, a VL CDR2 of SEQ ID NO: 165, and a VL CDR3 of SEQ ID NO: 171; or (iii) the VH comprises a VH CDR1 of SEQ ID NO: 321, a VH CDR2 of SEQ ID NO: 329, and a VH CDR3 of SEQ ID NO: 343, and the VL comprises a VL CDR1 of SEQ ID NO: 191, a VL CDR2 of SEQ ID NO: 200, and a VL CDR3 of SEQ ID NO: 210.

In another aspect, provided herein is an antibody or an antigen-binding fragment thereof that specifically binds to VISTA, wherein the antibody comprises a VH and a VL, wherein (i) the VH comprises a VH CDR1 of SEQ ID NO: 251, a VH CDR2 of SEQ ID NO: 258, and a VH CDR3 of SEQ ID NO: 270, and the VL comprises a VL CDR1 of SEQ ID NO: 115, a VL CDR2 of SEQ ID NO: 127, and a VL CDR3 of SEQ ID NO: 136; (ii) the VH comprises a VH CDR1 of SEQ ID NO: 288, a VH CDR2 of SEQ ID NO: 295, and a VH CDR3 of SEQ ID NO: 303, and the VL comprises a VL CDR1 of SEQ ID NO: 156, a VL CDR2 of SEQ ID NO: 166, and a VL CDR3 of SEQ ID NO: 172; or (iii) the VH comprises a VH CDR1 of SEQ ID NO: 322, a VH CDR2 of SEQ ID NO: 330, and a VH CDR3 of SEQ ID NO: 344, and the VL comprises a VL CDR1 of SEQ ID NO: 192, a VL CDR2 of SEQ ID NO: 201, and a VL CDR3 of SEQ ID NO: 211.

In another aspect, provided herein is an antibody or an antigen-binding fragment thereof that specifically binds to VISTA, wherein the antibody comprises a VH and a VL, wherein (i) the VH comprises a VH CDR1 of SEQ ID NO: 248, a VH CDR2 of SEQ ID NO: 259, and a VH CDR3 of SEQ ID NO: 271, and the VL comprises a VL CDR1 of SEQ ID NO: 116, a VL CDR2 of SEQ ID NO: 126, and a VL CDR3 of SEQ ID NO: 137; (ii) the VH comprises a VH CDR1 of SEQ ID NO: 285, a VH CDR2 of SEQ ID NO: 296, and a VH CDR3 of SEQ ID NO: 304, and the VL comprises a VL CDR1 of SEQ ID NO: 157, a VL CDR2 of SEQ ID NO: 165, and a VL CDR3 of SEQ ID NO: 173; or (iii) the VH comprises a VH CDR1 of SEQ ID NO: 319, a VH CDR2 of SEQ ID NO: 331, and a VH CDR3 of SEQ ID NO: 345, and the VL comprises a VL CDR1 of SEQ ID NO: 193, a VL CDR2 of SEQ ID NO: 200, and a VL CDR3 of SEQ ID NO: 212.

In another aspect, provided herein is an antibody or an antigen-binding fragment thereof that specifically binds to VISTA, wherein the antibody comprises a VH and a VL, wherein (i) the VH comprises a VH CDR1 of SEQ ID NO: 247, a VH CDR2 of SEQ ID NO: 254, and a VH CDR3 of SEQ ID NO: 277, and the VL comprises a VL CDR1 of SEQ ID NO: 111, a VL CDR2 of SEQ ID NO: 123, and a VL CDR3 of SEQ ID NO: 132; (ii) the VH comprises a VH CDR1 of SEQ ID NO: 284, a VH CDR2 of SEQ ID NO: 292, and a VH CDR3 of SEQ ID NO: 310, and the VL comprises a VL CDR1 of SEQ ID NO: 152, a VL CDR2 of SEQ ID NO: 163, and a VL CDR3 of SEQ ID NO: 168; or (iii) the VH comprises a VH CDR1 of SEQ ID NO: 318, a VH CDR2 of SEQ ID NO: 326, and a VH CDR3 of SEQ ID NO: 352, and the VL comprises a VL CDR1 of SEQ ID NO: 168, a VL CDR2 of SEQ ID NO: 197, and a VL CDR3 of SEQ ID NO: 207.

In a specific embodiment, the VH comprises the sequence of SEQ ID NO: 584. In a specific embodiment, the VL comprises the sequence of SEQ ID NO:84. In a specific embodiment, the VH comprises the sequence of SEQ ID NO: 584 and the VL comprises the sequence of SEQ ID NO: 84.

In a specific embodiment, the VH comprises the sequence of SEQ ID NO: 585. In a specific embodiment, the VL comprises the sequence of SEQ ID NO: 85. n a specific embodiment the VH comprises the sequence of SEQ ID NO: 585 and the VL comprises the sequence of SEQ ID NO: 85.

In a specific embodiment, the VH comprises the sequence of SEQ ID NO: 586. In a specific embodiment, the VL comprises the sequence of SEQ ID NO: 86. In a specific embodiment the VH comprises the sequence of SEQ ID NO: 586 and the VL comprises the sequence of SEQ ID NO: 86.

In a specific embodiment, the VH comprises the sequence of SEQ ID NO: 587. In a specific embodiment, the VL comprises the sequence of SEQ ID NO: 87. In a specific embodiment, the VH comprises the sequence of SEQ ID NO: 587 and the VL comprises the sequence of SEQ ID NO: 87.

In a specific embodiment, the VH comprises the sequence of SEQ ID NO: 588. In a specific embodiment, the VH comprises the sequence of SEQ ID NO: 588 and the VL comprises the sequence of SEQ ID NO: 88.

In a specific embodiment, the VH comprises the sequence of SEQ ID NO: 589. In a specific embodiment, the VL comprises the sequence of SEQ ID NO: 89. In a specific embodiment, the VH comprises the sequence of SEQ ID NO: 589 and the VL comprises the sequence of SEQ ID NO: 89.

In a specific embodiment, the VH comprises the sequence of SEQ ID NO: 592. In a specific embodiment, the VL comprises the sequence of SEQ ID NO: 86. In a specific embodiment, the VH comprises the sequence of SEQ ID NO: 592 and the VL comprises the sequence of SEQ ID NO: 86.

In a specific embodiment, the VH comprises the sequence of SEQ ID NO: 238. In a specific embodiment, the VL comprises the sequence of SEQ ID NO: 84. In a specific embodiment, the VH comprises the sequence of SEQ ID NO: 238 and the VL comprises the sequence of SEQ ID NO: 84.

In a specific embodiment, the VH comprises a sequence that has at least 95% identity to the sequence of SEQ ID NO:

584. In a specific embodiment, the VL comprises a sequence that has at least 95% identity to the sequence of SEQ ID NO: 84. In specific embodiments, the VH comprises a sequence that has at least 95% identity to the sequence of SEQ ID NO: 584 and the VL comprises a sequence that has at least 95% identity to sequence of SEQ ID NO: 84.

In a specific embodiment, the VH comprises a sequence that has at least 95% identity to sequence of SEQ ID NO: 585. In a specific embodiment, the VL comprises a sequence that has at least 95% identity to sequence of SEQ ID NO: 85. In a specific embodiment, the VH comprises a sequence that has at least 95% identity to sequence of SEQ ID NO: 585 and the VL comprises a sequence that has at least 95% identity to sequence of SEQ ID NO: 85.

In a specific embodiment, the VH comprises a sequence that has at least 95% identity to sequence of SEQ ID NO: 586. In a specific embodiment, the VL comprises a sequence that has at least 95% identity to sequence of SEQ ID NO: 86. In a specific embodiment, the VH comprises a sequence that has at least 95% identity to sequence of SEQ ID NO: 586 and the VL comprises a sequence that has at least 95% identity to sequence of SEQ ID NO: 86.

In a specific embodiment, the VH comprises a sequence that has at least 95% identity to sequence of SEQ ID NO: 587. In a specific embodiment, the VL comprises a sequence that has at least 95% identity to sequence of SEQ ID NO: 87. In a specific embodiment, the VH comprises a sequence that has at least 95% identity to sequence of SEQ ID NO: 587 and the VL comprises a sequence that has at least 95% identity to sequence of SEQ ID NO: 87.

In a specific embodiment, the VH comprises a sequence that has at least 95% identity to sequence of SEQ ID NO: 588. In a specific embodiment, the VL comprises a sequence that has at least 95% identity to sequence of SEQ ID NO: 88. In a specific embodiment, the VH comprises a sequence that has at least 95% identity to sequence of SEQ ID NO: 588 and the VL comprises a sequence that has at least 95% identity to sequence of SEQ ID NO: 88.

In a specific embodiment, the VH comprises a sequence that has at least 95% identity to sequence of SEQ ID NO: 589. In a specific embodiment, the VL comprises a sequence that has at least 95% identity to sequence of SEQ ID NO: 89. In a specific embodiment, the VH comprises a sequence that has at least 95% identity to sequence of SEQ ID NO: 589 and the VL comprises a sequence that has at least 95% identity to sequence of SEQ ID NO: 89.

In a specific embodiment, the VH comprises a sequence that has at least 95% identity to sequence of SEQ ID NO: 592. In a specific embodiment, the VL comprises a sequence that has at least 95% identity to sequence of SEQ ID NO: 86. In a specific embodiment, the VH comprises a sequence that has at least 95% identity to sequence of SEQ ID NO: 592 and the VL comprises a sequence that has at least 95% identity to sequence of SEQ ID NO: 86.

In a specific embodiment, the VH comprises a sequence that has at least 95% identity to sequence of SEQ ID NO: 238. In a specific embodiment, the VL comprises a sequence that has at least 95% identity to sequence of SEQ ID NO: 84. In a specific embodiment, the VH comprises a sequence that has at least 95% identity to sequence of SEQ ID NO: 238 and the VL comprises a sequence that has at least 95% identity to sequence of SEQ ID NO: 84.

In another aspect, provided herein is an antibody or an antigen-binding fragment thereof that specifically binds to VISTA, wherein the antibody comprises a VH and a VL, wherein the VH comprises a VH CDR1, a VH CDR2 and a VH CDR3, and wherein the VH CDR1 is of the SEQ ID NO: set forth in Table 1 as the VH CDR1 for an Antibody No. listed in Table 1, and the VH CDR2 is of the SEQ ID NO: set forth in Table 1 as the VH CDR2 for said antibody, and the VH CDR3 is of the SEQ ID NO: set forth in Table 1 as the VH CDR3 for said antibody.

In another aspect, provided herein is an antibody or an antigen-binding fragment thereof that specifically binds to VISTA, wherein the antibody comprises a VH and a VL, wherein the VH comprises a VH CDR1, a VH CDR2 and a VH CDR3, and wherein the VH CDR1 is of the SEQ ID NO: set forth in Table 2 as the VH CDR1 for an Antibody No. listed in Table 2, and the VH CDR2 is of the SEQ ID NO: set forth in Table 2 as the VH CDR2 for said antibody, and the VH CDR3 is of the SEQ ID NO: set forth in Table 2 as the VH CDR3 for said antibody.

In another aspect, provided herein is an antibody or an antigen-binding fragment thereof that specifically binds to VISTA, wherein the antibody comprises a VH and a VL, wherein the VH comprises a VH CDR1, a VH CDR2 and a VH CDR3, and wherein the VH CDR1 is of the SEQ ID NO: set forth in Table 3 as the VH CDR1 for an Antibody No. listed in Table 3, and the VH CDR2 is of the SEQ ID NO: set forth in Table 3 as the VH CDR2 for said antibody, and the VH CDR3 is of the SEQ ID NO: set forth in Table 3 as the VH CDR3 for said antibody.

In another aspect, provided herein is an antibody or an antigen-binding fragment thereof that specifically binds to VISTA, wherein the antibody comprises a VH and a VL, wherein (i) the VH comprises a VH CDR1, a VH CDR2 and a VH CDR3, and wherein the VH CDR1 is of the SEQ ID NO: set forth in Table 1 as the VH CDR1 for an Antibody No. listed in Table 1, and the VH CDR2 is of the SEQ ID NO: set forth in Table 1 as the VH CDR2 for said antibody, and the VH CDR3 is of the SEQ ID NO: set forth in Table 1 as the VH CDR3 for said antibody and (ii) the VL comprises a VL CDR1, a VL CDR2 and a VL CDR3, and wherein the VL CDR1 is of the SEQ ID NO: set forth in Table 4 as the VL CDR1 for said antibody, the VL CDR2 is of the SEQ ID NO: set forth in Table 4 as the VL CDR2 for said antibody, and the VL CDR3 is of the SEQ ID NO: set forth in Table 4 as the VL CDR3 for said antibody.

In another aspect, provided herein is an antibody or an antigen-binding fragment thereof that specifically binds to VISTA, wherein the antibody comprises a VH and a VL, wherein (i) the VH comprises a VH CDR1, a VH CDR2 and a VH CDR3, and wherein the VH CDR1 is of the SEQ ID NO: set forth in Table 2 as the VH CDR1 for an Antibody No. listed in Table 2, and the VH CDR2 is of the SEQ ID NO: set forth in Table 2 as the VH CDR2 for said antibody, and the VH CDR3 is of the SEQ ID NO: set forth in Table 2 as the VH CDR3 for said antibody and (ii) the VL comprises a VL CDR1, a VL CDR2 and a VL CDR3, and wherein the VL CDR1 is of the SEQ ID NO: set forth in Table 5 as the VL CDR1 for said antibody, the VL CDR2 is of the SEQ ID NO: set forth in Table 5 as the VL CDR2 for said antibody, and the VL CDR3 is of the SEQ ID NO: set forth in Table 5 as the VL CDR3 for said antibody.

In another aspect, provided herein is an antibody or an antigen-binding fragment thereof that specifically binds to VISTA, wherein the antibody comprises a VH and a VL, wherein (i) the VH comprises a VH CDR1, a VH CDR2 and a VH CDR3, and wherein the VH CDR1 is of the SEQ ID NO: set forth in Table 3 as the VH CDR1 for an Antibody No. listed in Table 3, and the VH CDR2 is of the SEQ ID NO: set forth in Table 3 as the VH CDR2 for said antibody, and the VH CDR3 is of the SEQ ID NO: set forth in Table 3 as the VH CDR3 for said antibody and (ii) the VL comprises a VL CDR1, a VL CDR2 and a VL CDR3, and wherein the VL CDR1 is of the SEQ ID NO: set forth in Table 6 as the VL CDR1 for said antibody, the VL CDR2 is of the SEQ ID NO: set forth in Table 6 as the VL CDR2 for said antibody, and the VL CDR3 is of the SEQ ID NO: set forth in Table 6 as the VL CDR3 for said antibody.

In a specific embodiment, the VH comprises the SEQ ID NO: set forth in Table 7 as the VH for an antibody. In a specific embodiment, the VH comprises the SEQ ID NO: set forth in Table 7 as the VH for an antibody and the VL comprises the SEQ ID NO: set forth in Table 8 as the VL for said antibody.

In another aspect, provided herein is an antibody or an antigen-binding fragment thereof that specifically binds to VISTA, wherein the antibody comprises a heavy chain and a light chain, and wherein the light chain is of the SEQ ID NO: set forth in Table 9 as the light chain for an Antibody No. listed in Table 9, and the heavy chain is of the SEQ ID NO: set forth in Table 9 as the heavy chain for said antibody.

In a specific embodiment, the antibody or antigen-binding fragment specifically binds to human VISTA (amino acids 33-311 of SEQ ID NO: 377).

In another aspect, provided herein is an antibody or an antigen-binding fragment thereof that specifically binds to VISTA, wherein the antibody recognizes an epitope of human VISTA comprising the amino acid sequence HLHHG (amino acids 98-102 of SEQ ID NO: 377, numbering begins with the first amino acid after the signal sequence (signal sequence is underlined, in bold, Table11)) or VVEIRHHHSEHR (amino acids 148-159 of SEQ ID NO: 377, numbering begins with the first amino acid after the signal sequence (underlined, in bold Table 11)). In another embodiment, the antibody recognizes an epitope of human VISTA comprising Tyrosine 37, Arginine 54, Valine 117 and Arginine 127 of SEQ ID NO:377 (numbering begins with the first amino acid after the signal sequence (underlined, in bold in Table 11)).

In another aspect, provided herein is an antibody or antigen-binding fragment thereof which competes for binding to VISTA with a reference antibody selected from the group consisting of: (a) a first immunoglobulin comprising (i) a VH comprising the sequence of SEQ ID NO: 584 and (ii) a VL comprising the sequence of SEQ ID NO: 84; (b) a second immunoglobulin comprising (i) a VH comprising the sequence of SEQ ID NO: 585 and (ii) a VL comprising the sequence of SEQ ID NO: 85; (c) a third immunoglobulin comprising (i) a VH comprising the sequence of SEQ ID NO: 586 and (ii) a VL comprising the sequence of SEQ ID NO: 86; (d) a fourth immunoglobulin comprising (i) a VH comprising the sequence of SEQ ID NO: 587 and (ii) a VL comprising the sequence of SEQ ID NO: 87; (e) a fifth immunoglobulin comprising (i) a VH comprising the sequence of SEQ ID NO: 588 and (ii) a VL comprising the sequence of SEQ ID NO: 88; (f) a sixth immunoglobulin comprising (i) a VH comprising the sequence of SEQ ID NO: 589 and (ii) a VL comprising the sequence of SEQ ID NO: 89; (g) a seventh immunoglobulin comprising (i) a VH comprising the sequence of SEQ ID NO: 238 and (ii) a VL comprising the sequence of SEQ ID NO: 84; and (h) an eighth immunoglobulin comprising (i) a VH comprising the sequence of SEQ ID NO:592 and (ii) a VL comprising the sequence of SEQ ID NO: 86.

In a specific embodiment, the antibody is a monoclonal antibody. In a specific embodiment, the antibody is a human antibody. In a specific embodiment, the antibody is an immunoglobulin.

In a specific embodiment, the antibody comprises an Fc region or a variant of the Fc region; optionally wherein the Fc region is a human Fc region or a variant of the human Fc region that has in the range of one to seven amino acid mutations in the Fe region relative to the native human Fc region, and/or optionally wherein the human Fc region is of a human IgG1, human IgG2 or a human IgG4, further optionally wherein the antibody comprises a constant region of a human IgG1 or a human IgG4 or a variant of the constant region that has in the range of one to seven amino acid mutations in the constant region relative to the native constant region.

In a specific embodiment, the antibody mediates antibody-dependent cell-mediated cytotoxicity (ADCC). In a specific embodiment, the antibody mediates complement-dependent cell-mediated cytotoxicity (CDC). In a specific embodiment, the antibody mediates antibody-dependent cellular phagocytosis (ADCP).

In a specific embodiment, the antibody comprises said variant of the human Fc region. In a specific embodiment, (a) the Fc region is of a human IgG1, wherein the mutations are selected from the group consisting of C220D, D221C, E233P, L234A, L234E, L234Y, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, E318A, K322A, S324T, K326A, K326M, L328R, P329A, P329G, A330L, A330S, P331A, P331S, 1332E, E333A, E333S, K334A, A378V, S383N, M428L, N434S, and N434Y, wherein the residues are numbered using the EU numbering system; (b) the Fc region is of a human IgG2, and wherein the mutations are selected from the group consisting of C220D, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, A330L, A330S, P331A, P331S, 1332E, E333A, E333S, K334A, S383N, M428L, N434S, and N434Y, wherein the residues are numbered using the EU numbering system; or (c) the Fc region is of a human IgG4, and wherein the mutations are selected from the group consisting of S228P, E233P, F234A, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, 1332E, E333A, E333S, K334A, A378V, S383N, M428L, N434S, and N434Y, wherein the residues are numbered using the EU numbering system.

In a specific embodiment, the Fe region (a) is of a human IgG1, wherein the mutations comprise L234A and L235A, and optionally P329G, wherein the residues are numbered using the EU numbering system; or (b) is of a human IgG4, and wherein the mutations comprise F234A and L235A, and optionally P329G, wherein the residues are numbered using the EU numbering system.

In a specific embodiment, the Fc region is of a human IgG1, IgG2, or IgG4, wherein the mutations comprise M252Y, S254T, and T256E, wherein the residues are numbered using the EU numbering system.

In a specific embodiment, the Fc region is of a human IgG1, IgG2 or IgG4, wherein the mutations comprise M428L and N434S, wherein the residues are numbered using the EU numbering system.

In a specific embodiment, the Fc region is of a human IgG4, wherein the mutations comprise S228P and L235E, wherein the residues are numbered using the EU numbering system.

In one embodiment, the Fc region is a human IgG4, and the mutations comprise S228P, M252Y, S254T, and T256E, wherein the residues are numbered using the EU numbering system.

In one embodiment, the Fe region is of a human IgG4, wherein the mutations comprise S228P, M428L and N434S, wherein the residues are numbered using the EU numbering system.

In a specific embodiment, the antibody or antigen-binding fragment is a bispecific antibody or a trispecific antibody. In another embodiment, the antibody or antigen-binding fragment is a BiTE or TriKE.

In a specific embodiment, the antigen-binding fragment is an Fv fragment, a Fab fragment, or a $F(ab')_2$ fragment.

In a specific embodiment, the antibody or antigen-binding fragment thereof is purified. In another embodiment, the antibody, or antigen-binding fragment, is isolated.

In another aspect, provided herein is a single-chain Fv (scFv) comprising a VH and a VL separated by a linker sequence, wherein the VH comprises a VH CDR1, a VH CDR2 and a VH CDR3, the VH CDR1 is of the SEQ ID NO: set forth in a table selected from the group consisting of Tables 1-3 as the VH CDR1 for an Antibody No. listed in said table, and the VH CDR2 is of the SEQ ID NO: set forth in said table as the VH CDR2 for said antibody, and the VH CDR3 is of the SEQ ID NO: set forth in said table as the VH CDR3 for said antibody. In a specific embodiment, the VL comprises a VL CDR1, a VL CDR2 and a VL CDR3, and wherein the VL CDR1 is of the SEQ ID NO: set forth in a table selected from the group consisting of Tables 4-6 as the VL CDR1 for said antibody, the VL CDR2 is of the SEQ ID NO: set forth in said table as the VL CDR2 for said antibody, and the VL CDR3 is of the SEQ ID NO: set forth in said table as the VL CDR3 for said antibody, wherein the VL CDR1, VL CDR2, VL CDR3, VH CDR1, VH CDR2 and VH CDR3 all are defined by the same CDR numbering system. In a specific embodiment, the VH comprises the SEQ ID NO: set forth in Table 7 as the VH of said antibody. In a specific embodiment, the VL comprises the SEQ ID NO: set forth in Table 8 as the VL of said antibody.

In another aspect, provided herein is a fusion protein comprising an scFv provided herein.

In another aspect, provided herein is an antibody-drug conjugate comprising the antibody or antigen-binding fragment, the scFv, or the fusion protein of any of the preceding embodiments bound (optionally covalently bound) to a therapeutic agent.

In another aspect, provided herein is a chimeric antigen receptor (CAR) comprising the scFv of any of the preceding embodiments. Also provided herein is a cell which expresses the CAR.

In another aspect, provided herein is a polynucleotide comprising a nucleotide sequence encoding the antibody or antigen-binding fragment, the scFv, the fusion protein, or the CAR of any of the preceding embodiments.

In another aspect, provided herein is an ex vivo cell containing one or more polynucleotides each comprising a nucleotide sequence encoding the antibody or antigen-binding fragment, the scFv, the fusion protein, or the CAR of any of the preceding embodiments. Also provided herein is a method of producing an antibody or antigen-binding fragment or scFv or fusion protein or CAR comprising culturing the cell under conditions such that said one or more polynucleotides are expressed by the cell to produce the antibody or antigen-binding fragment or scFv or fusion protein or CAR encoded by the polynucleotides.

In another aspect, provided herein is a pharmaceutical composition comprising (a) a therapeutically effective amount of the antibody or antigen-binding fragment, the scFv, the fusion protein, the CAR, the antibody-drug conjugate, or the cell of any of the preceding embodiments; and (b) a pharmaceutically acceptable carrier. Also provided herein is a method of treating cancer in a subject in need thereof, comprising administering to said subject the pharmaceutical composition. In a specific embodiment, the cancer is a non-small cell lung cancer, a small cell lung cancer, a head and neck squamous cell carcinoma, a blood cancer, an hepatocellular carcinoma, an ovarian cancer, a mesothelioma, a neuroblastoma, an oral cancer, a thyroid cancer, a breast cancer, a sarcoma, a pancreatic cancer, a colon cancer, a gastric cancer, a choriocarcinoma, a testicular cancer, a skin cancer, a renal cell carcinoma, a bladder cancer, a hematological cancer (e.g., an acute myeloid leukemia), or a cervical cancer. In one embodiment, the cancer is a myelodysplastic syndrome. In a specific embodiment, the cancer is metastatic cancer. In a specific embodiment, the cancer is an acute myeloid leukemia, and wherein the pharmaceutical composition comprises a therapeutically effective amount of the antibody-drug conjugate, wherein the therapeutic agent optionally is a cytotoxic agent.

In a specific embodiment, the method of treating cancer further comprises administering to the subject an additional therapy. In a specific embodiment, the additional therapy is for treating the cancer. In a specific embodiment, the method of treating cancer further comprises administering to the subject a chemotherapeutic agent, a tyrosine kinase inhibitor, and/or an immune checkpoint inhibitor. In a specific embodiment, the method of treating cancer further comprises administering to the subject the immune checkpoint inhibitor, wherein the immune checkpoint inhibitor is an inhibitor of Programmed Death-1 (PD-1), or Programmed death-ligand 1 (PDL1), or cytotoxic T-lymphocyte-associated protein 4 (CTLA-4). In a specific embodiment, said subject is a human. In one embodiment, the additional therapy is radiotherapy.

Induced ADCC activity was quantified on a CLARIOstar Plus by short term time-resolved fluorometry detection of DELFIA® EuTDA Cytotoxicity Reagents. Antibodies tested are shown in the legend.

Figure 53:
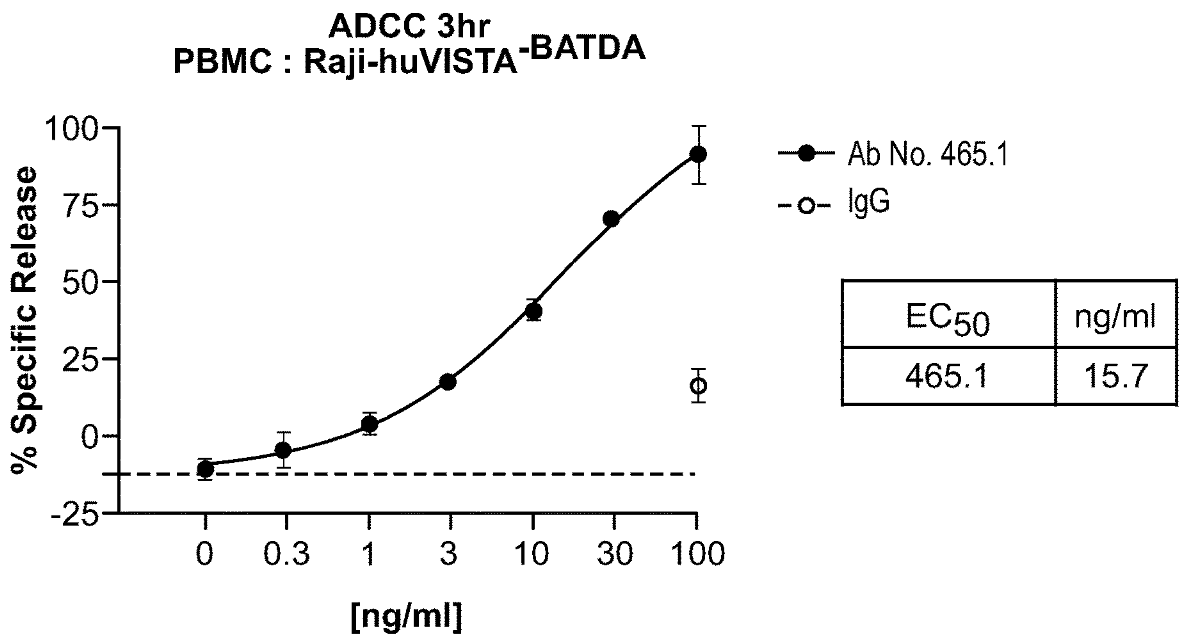

FIG. 53. Dose-response effect of anti-VISTA antibody No. 465.1 with effector PBMCs on ADCC activity against target Raji cells expressing human VISTA (Raji-hVISTA cells) at 3 hrs. Effector cells ($5\times10^5$ human PBMCs) were co-cultured with target cells ($1\times10^4$ Raji-hVISTA cells labelled with BATDA) in the presence of antibody No. 465.1 or control Ab at 100, 30, 10, 3.0, 1.0, or 0.3 ng/ml for 3 hrs. Induced ADCC activity was quantified on a CLARIOstar Plus by short term time-resolved fluorometry detection of DELFIA® EuTDA Cytotoxicity Reagents.

Figure 54:
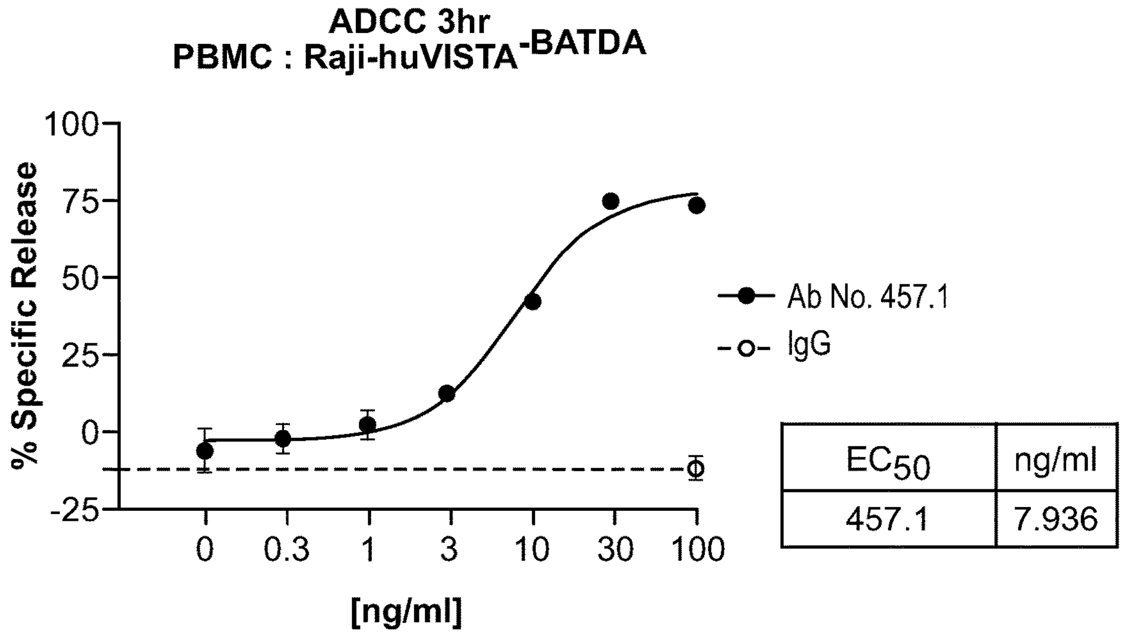

FIG. 54. Dose-response effect of anti-VISTA antibody No. 457.1 with effector PBMCs on ADCC activity against target Raji cells expressing human VISTA (Raji-hVISTA cells) at 3 hrs. Effector cells ($5\times10^5$ human PBMCs) were co-cultured with target cells ($1\times10^4$ Raji-hVISTA cells labelled with BATDA) in the presence of antibody No. 457.1 or control Ab at 100, 30, 10, 3.0, 1.0, or 0.3 ng/ml for 3 hrs. Induced ADCC activity was quantified on a CLARIOstar Plus by short term time-resolved fluorometry detection of DELFIA® EuTDA Cytotoxicity Reagents.

Figure 55A:
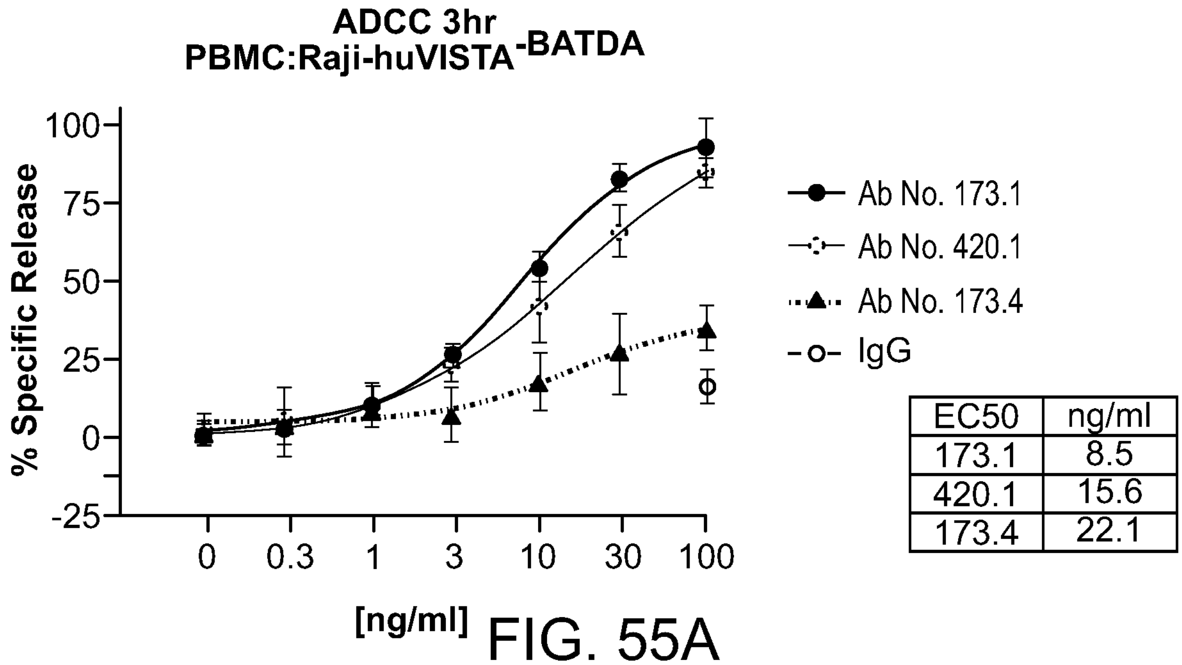

FIG. 55A. Dose-response effect of anti-VISTA antibodies No. 173.1, No. 173.4 and No. 420.1 with effector PBMCs on ADCC activity against target Raji cells expressing human VISTA (Raji-hVISTA cells)at 3 hrs. Effector cells ($5\times10^5$ human PBMCs) were co-cultured with target cells ($1\times10^4$ Raji-hVISTA cells labelled with BATDA) in the presence of antibody No. 173.1 (WT, IgG1), antibody No. 420.1 (YTE), antibody No. 173.4 (WT, IgG4) or control Ab at 100, 30, 10, 3.0, 1.0, or 0.3 ng/ml for 3 hrs. Induced ADCC activity was quantified on a CLARIOstar Plus by short term time-resolved fluorometry detection of DELFIA® EuTDA Cytotoxicity Reagents. Antibodies tested are shown in the legend.

Figure 55B:
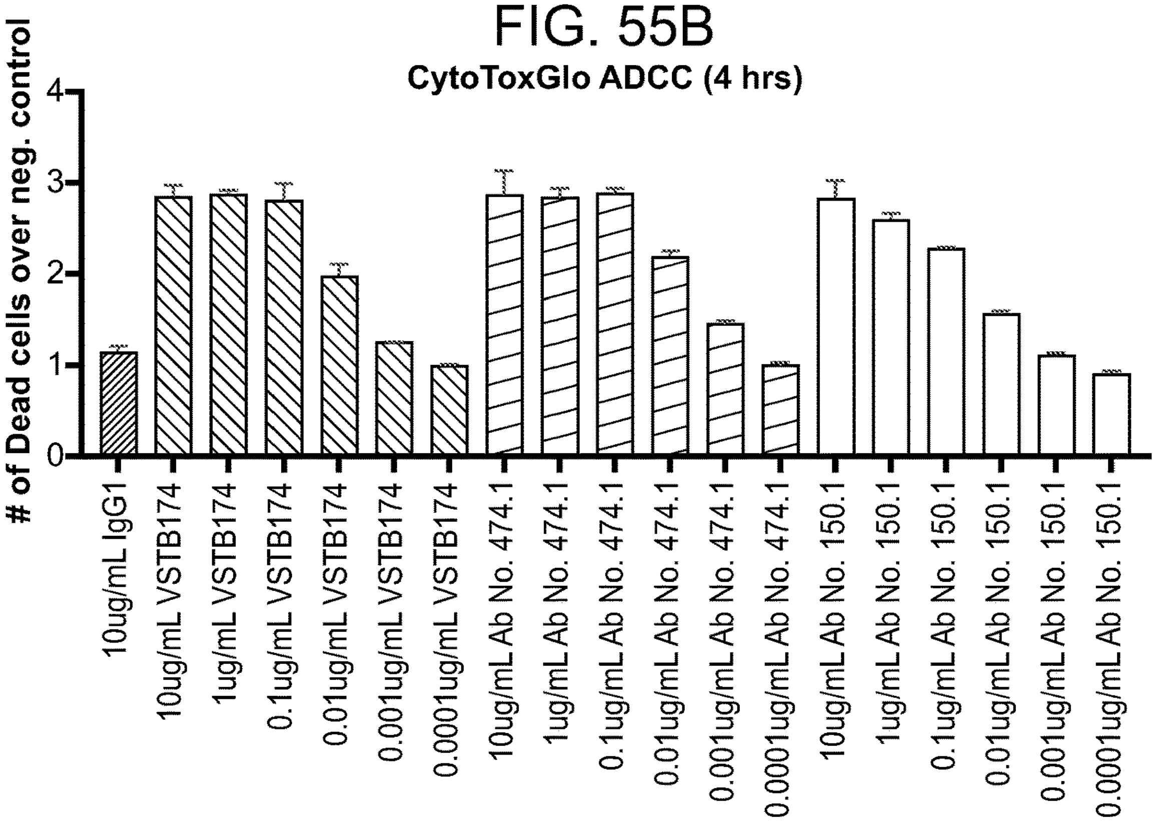
Figure 55C:
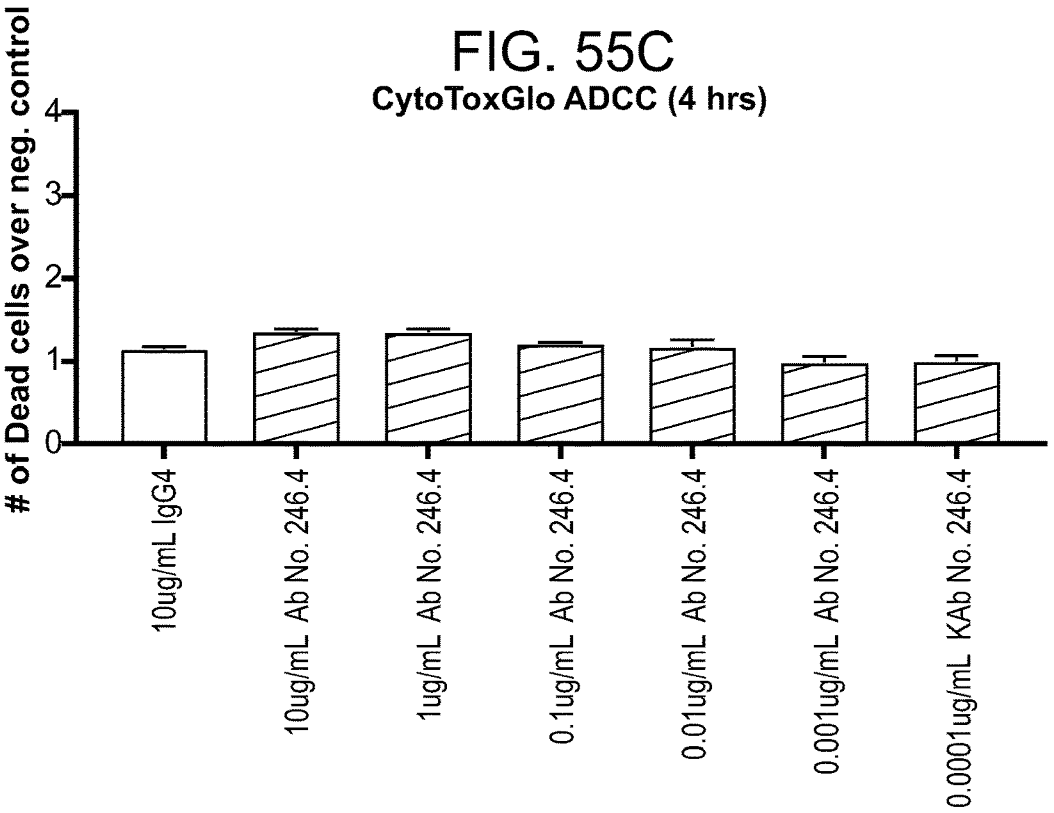

FIGS. 55B-55C. Cell death was measured by luminescence in the presence of CytoTox-Glo Reagent. $5\times10^5$/well PBMCs were incubated O/N with 200 u/mL IL-2 in X-VIVO-15 medium in the 96-well plates. Antibodies and $4\times10^4$/well hVISTA-Raji cells were added into 96-well plates, mixed and incubated for 4 hours using an Effector: Target (E:T) ratio of 12:1 (n=2). Data from one donor representative of 6 health donors.

FIG. 55D. CDC assay. Cell death was measured by luminescence in the presence of CytoTox-Glo Reagent. $1\times10^5$/well Raji+ hVISTA cells were plated in X-VIVO-15 medium in the 96-well plates. Antibodies and 25% Human Serum were added into 96-well plates, mixed and incubated for 6 hours.

FIG. 56A. In vivo anti-tumor efficacy of anti-VISTA antibody No. 245.2 in a MC38 tumor model in human VISTA knock-in (KI) mouse. VISTA KI mice were injected subcutaneously with $1\times10^6$ MC38 cells and randomized after tumor volumes reached approximately 70-100 mm$^3$. Then, mice were treated by intraperitoneal (IP) injection with vehicle control, with 10 mg/kg of antibody No. 245.2 (3 times a week), or with 5 mg/kg anti-PD1 antibody (twice a week), or with a combination of antibody No. 245.2 and anti-PD1 antibody each with the respective monotherapy dose frequency and amount. Tumor volumes were measured twice per week in two dimensions using a caliper, and the volume was expressed in mm$^3$ using the formula: "V=(L×W×W)/2," where V is tumor volume, L is tumor length (the longest tumor dimension) and W is tumor width (the longest tumor dimension perpendicular to L).

Figure 56B:
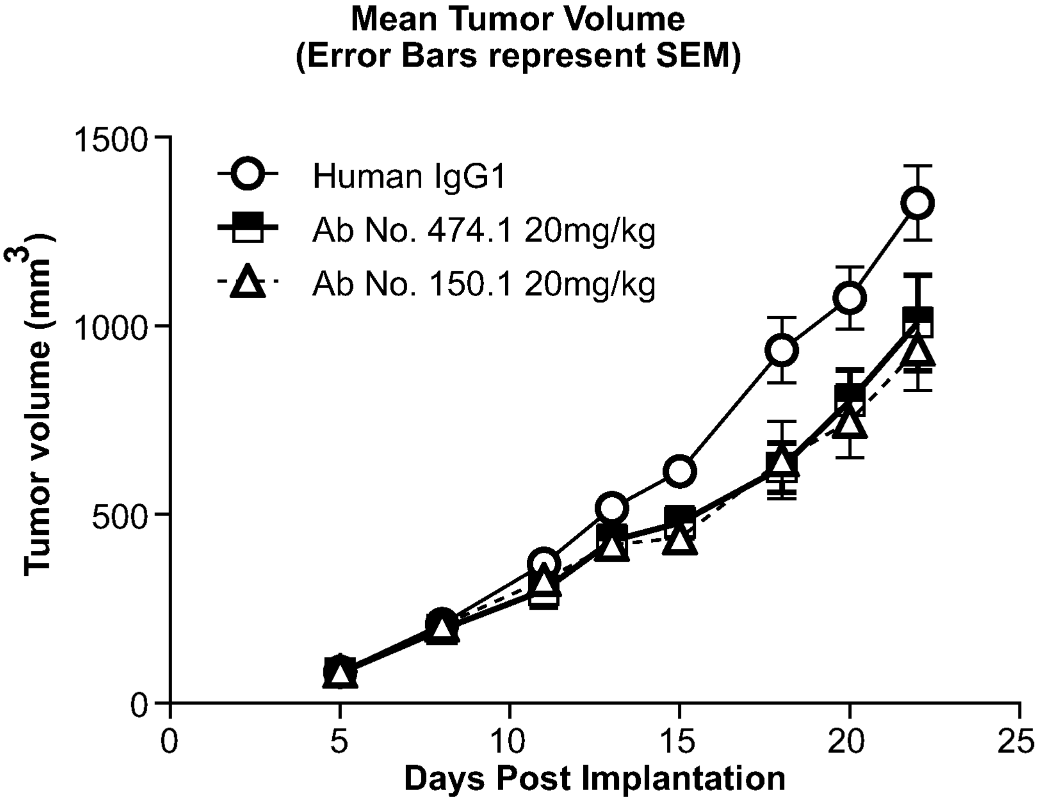

FIG. 56B. In vivo anti-tumor efficacy of Ab No. 474.1 and Ab No. 150.1 in an MB49 tumor model in the VISTA KI mouse. VISTA KI mice were injected subcutaneously with $5\times10^5$ MB49 cells and randomized after tumor volume reached approximately 70-100 mm3. Mice were treated by intraperitoneal (IP) injection two times a week for three weeks beginning on Day 5 with 20 mg/kg of Ab No. 474.1, Ab No. 150.1, or human IgG1. Tumor volumes were measured three times per week in two dimensions using calipers and the volume is expressed in mm3 using the formula V=(L×W×W)/2, where V is tumor volume, L is tumor length (the longest tumor dimension), and W is tumor width (the longest tumor dimension perpendicular to L). Error bars represent SEM.

Figure 56C:
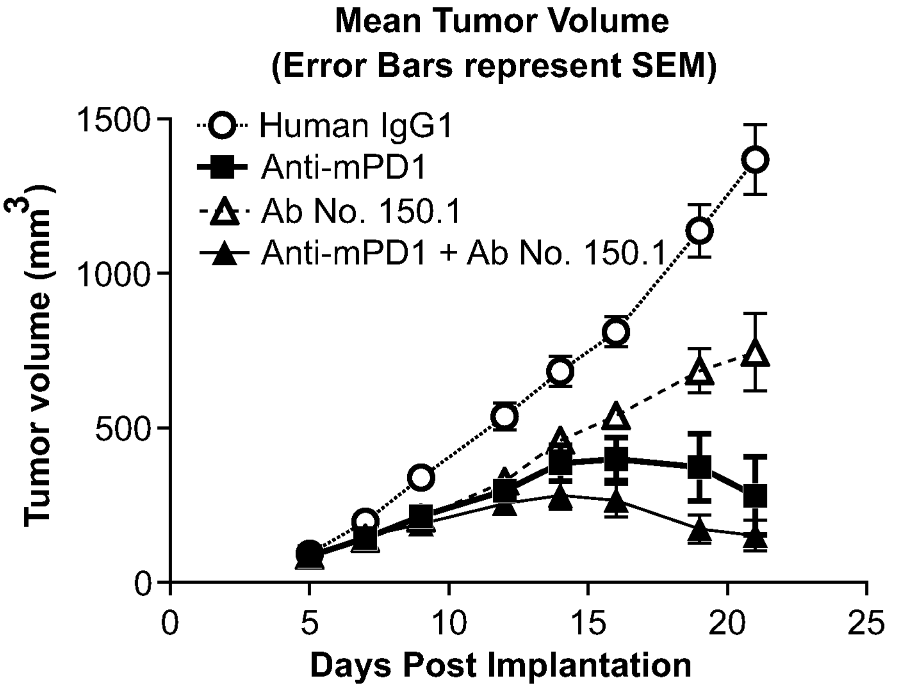
Figures 56D, 56E, 56F, 56G, 56H:
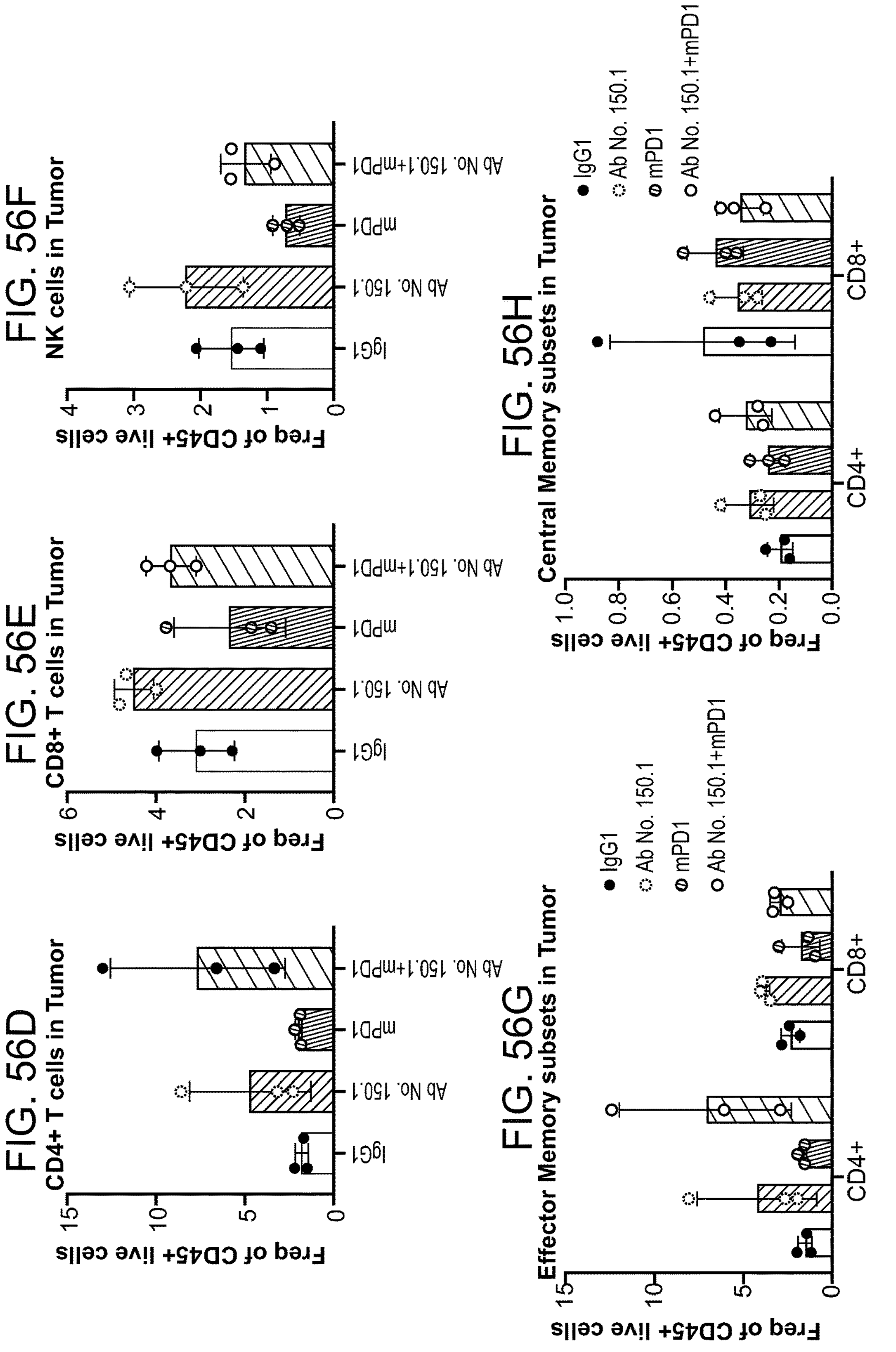
Figure 56I:
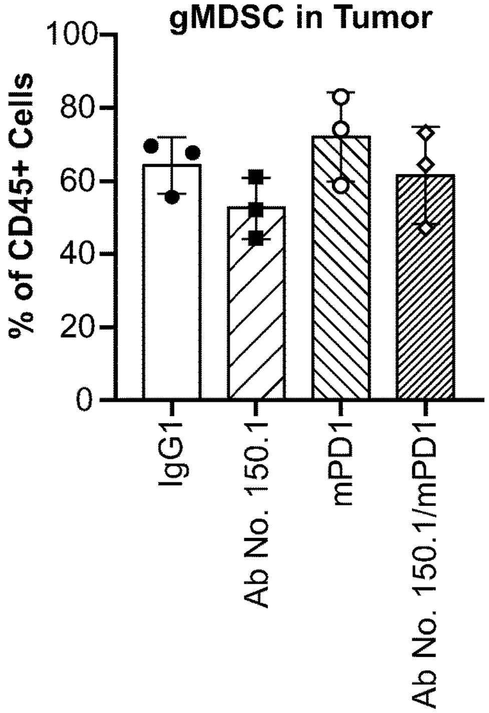
Figure 56J:
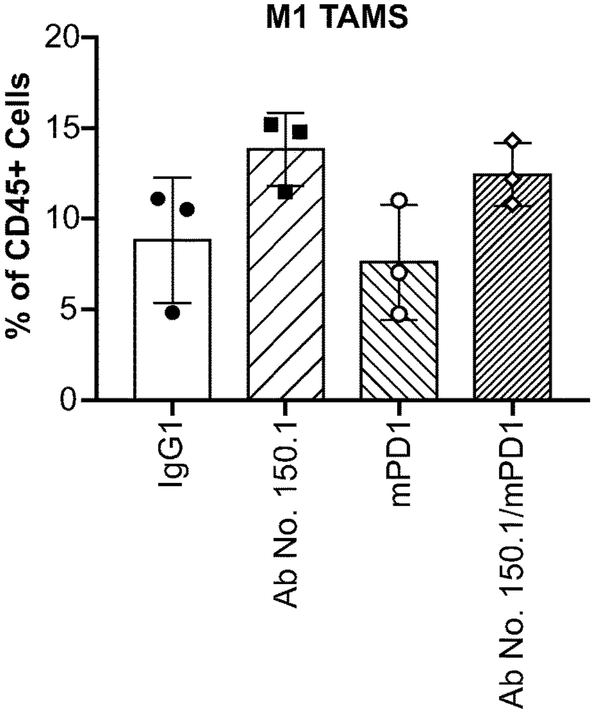
Figure 56K:
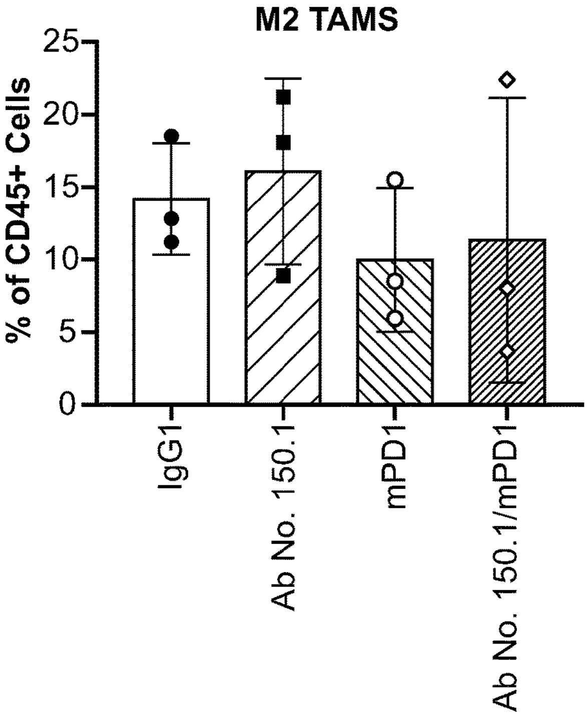
Figure 56L:
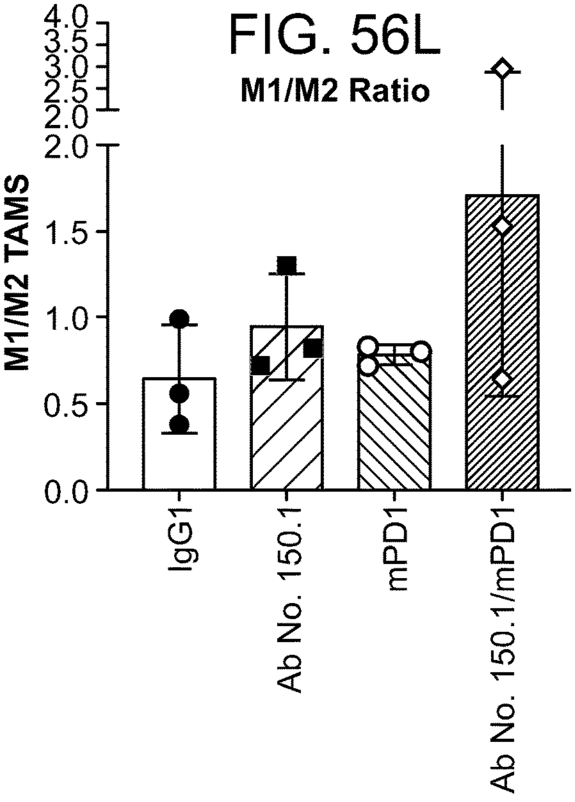

FIG. 56C. In vivo anti-tumor efficacy of Ab No. 150.1 in an MB49 tumor model in the VISTA KI mouse. VISTA KI mice were injected subcutaneously with $5\times10^5$ MB49 cells and randomized after tumor volume reached approximately 70-100 mm$^3$. Mice were treated by intraperitoneal (IP) injection two times a week for three weeks beginning on Day 5 with 20 mg/kg of Ab No. 150.1, 5 mg/kg anti-mPD1, or a combo-therapy. Tumor volumes were measured three times per week in two dimensions using calipers and the volume is expressed in mm$^3$ using the formula V=(L×W×W)/2, where V is tumor volume, L is tumor length (the longest tumor dimension), and W is tumor width (the longest tumor dimension perpendicular to L). Error bars represent SEM.

FIG. 56D-56L. Tumor samples were harvested from hVISTA KI C57B/6 mice treated with hIgG (20 mg/kg), Ab No. 150.1 (20 mg/kg), mPD1 (5 mg/kg), and combo treatment with Ab No. 150.1 with mPD1 (n=3) 24 hours after the 3rd dose on Day 12. Tumors were dissociated into single cell suspension and stained with lymphoid panel and then RBC were lysed with Biolegend RBC Lysis buffer. Cells were fixed with BD cytofix and analyzed via flow cytometry (Attune Nxt). gMDSC, granular Myeloid Derived Suppressor Cell; M1 TAM, M1 type Tumor Associated Macrophage; M2 TAM, M2 type Tumor Associated Macrophage.

Figure 57A:
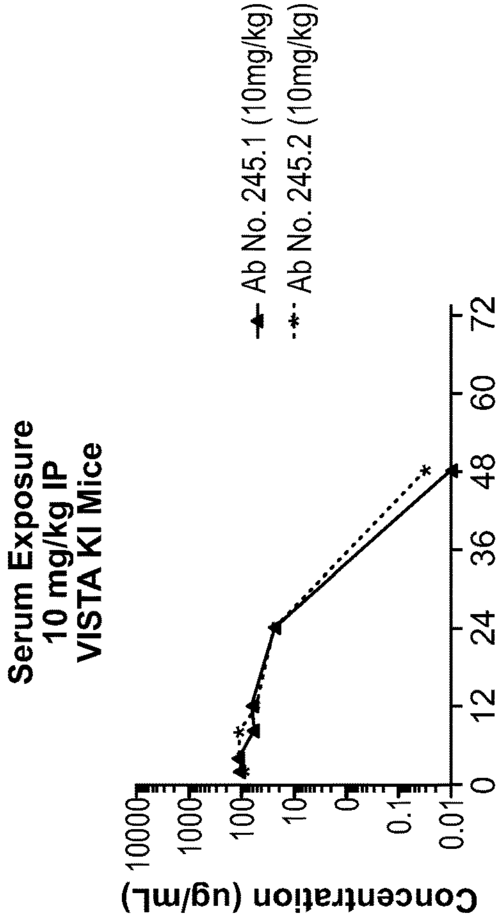
Figure 57B:
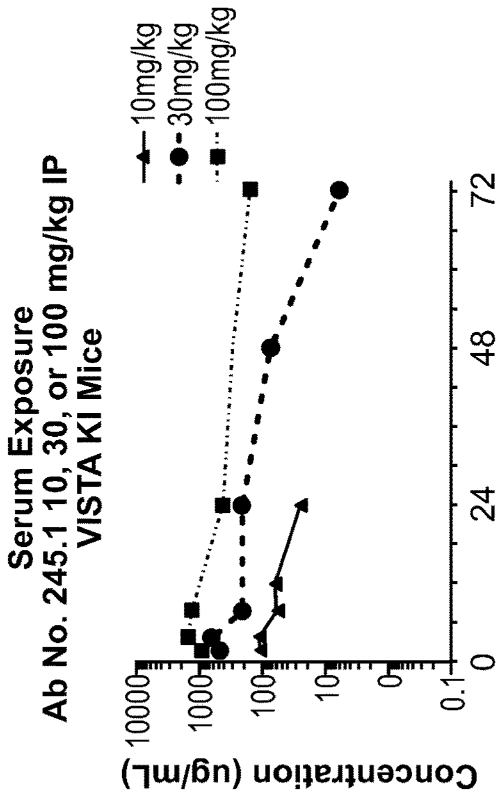

FIGS. 57A and 57B. Individual concentrations of anti-VISTA antibodies over time in serum following a single intraperitoneal (IP) dose in human VISTA KI mice. (Samples in duplicate). Antibodies tested are shown in the legend.

Figure 57C:
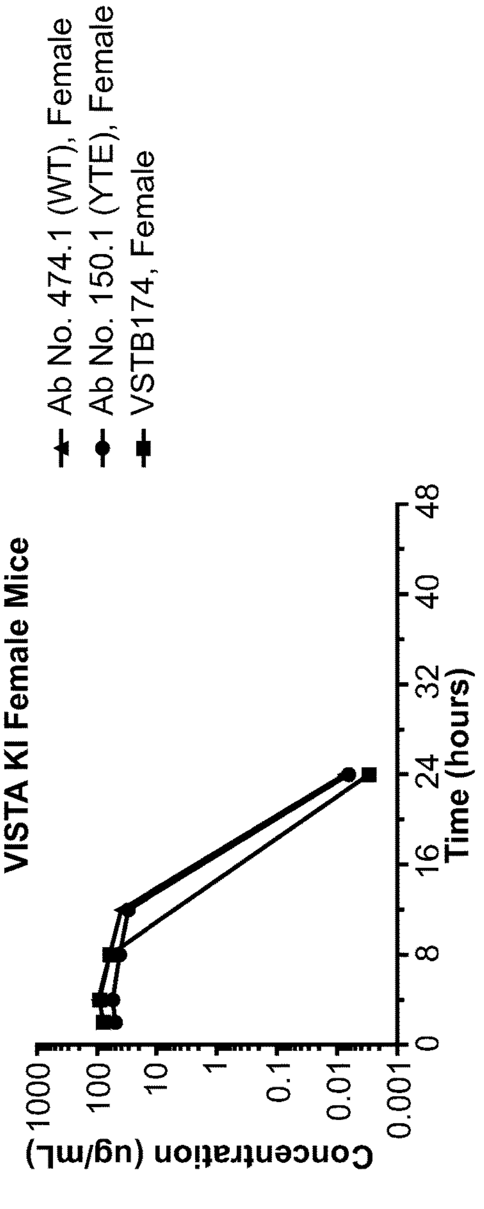

FIG. 57C. Individual concentrations of Anti-VISTA Abs vs. time in sera following a single IP dose in female human VISTA KI mice (Samples in duplicate).

Figure 57D:
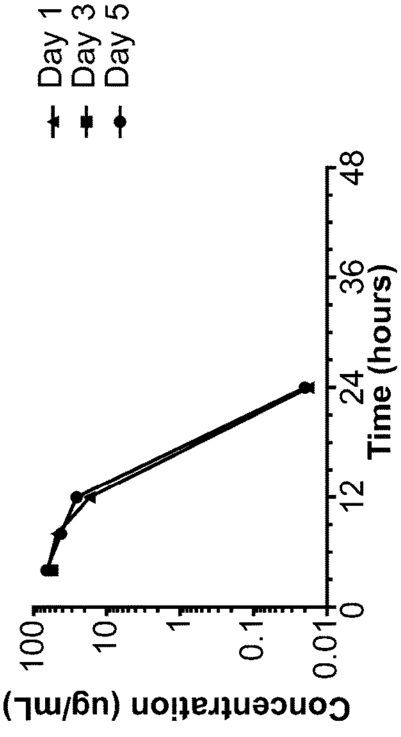
Figure 57E:
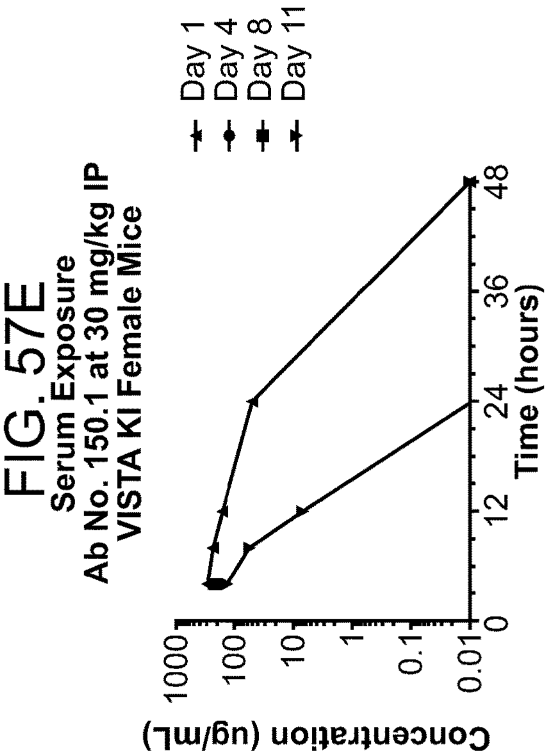
Figure 57F:
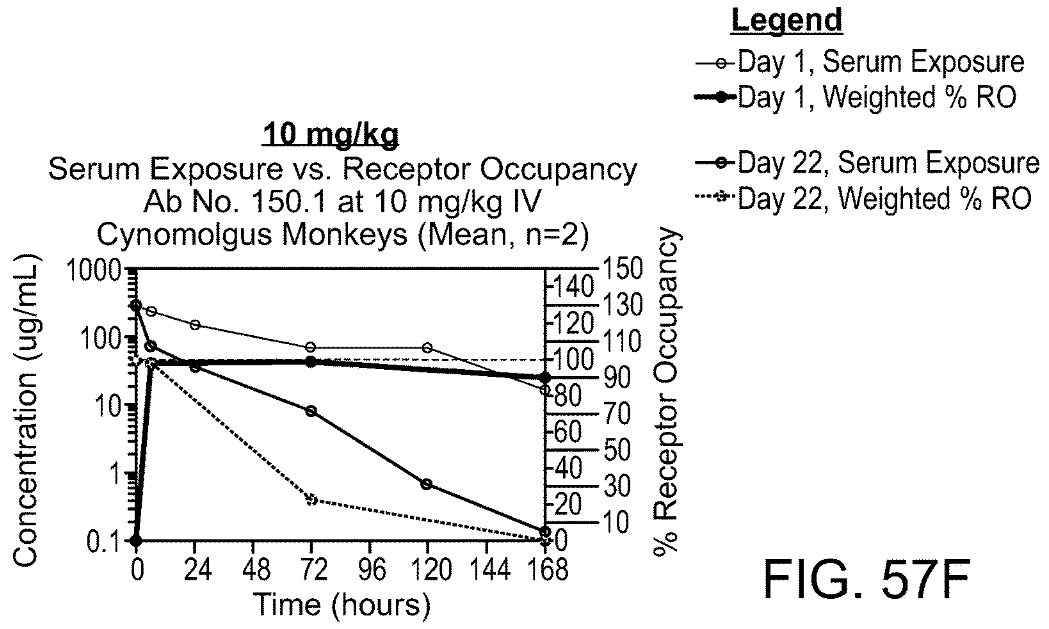
Figure 57G:
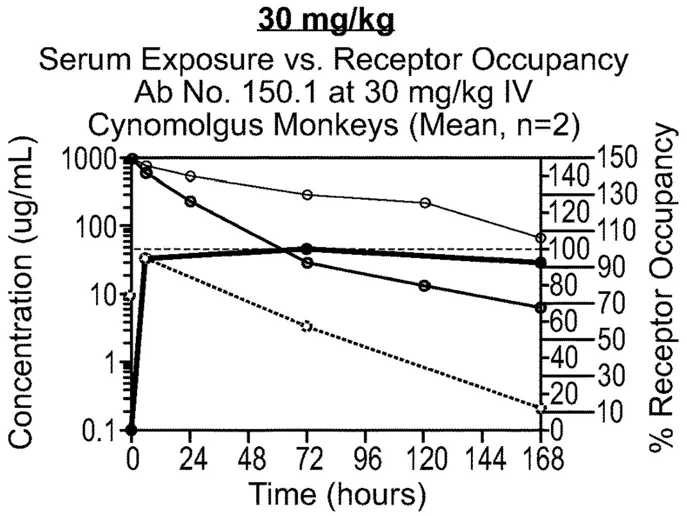
Figure 57H:
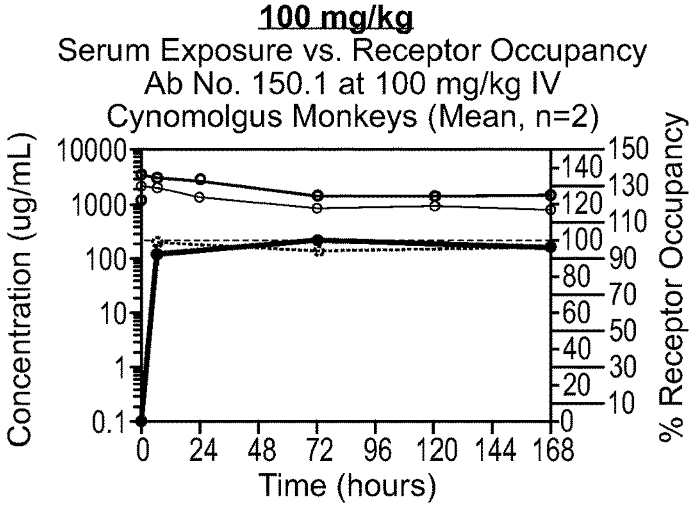

FIGS. 57D-57E. Individual concentrations of Anti-VISTA Abs vs. time in sera following a single or repeated IP doses in female human VISTA KI mice (Samples in duplicate).

FIGS. 57F-57N. Antibody Concentration (ug/mL, gray) and Receptor Occupancy (%, black) of Ab No. 150.1 vs. time in sera following a single (filled symbol) or four weekly IV doses (open symbol) of 10 mg/kg, 30 mg/kg, or 100 mg/kg in cynomolgus monkey. Shown are data for Group means, male (M), and female (F) animals assigned to the respective groups. 10 mg/kg: Legend: A. Group Mean, D. Animal 2001 (M), G. Animal 2601 (F). 30 mg/kg: B. Group Mean, E. Animal 3001 (M), H. Animal 3501 (G). 100 mg/kg: C. Group Mean, F. Animal 4001 (M), I. Animal 4501 (F). Dotted line=100% receptor occupancy.

Figures 58A, 58B, 58C, 58D, 58E, 58F:
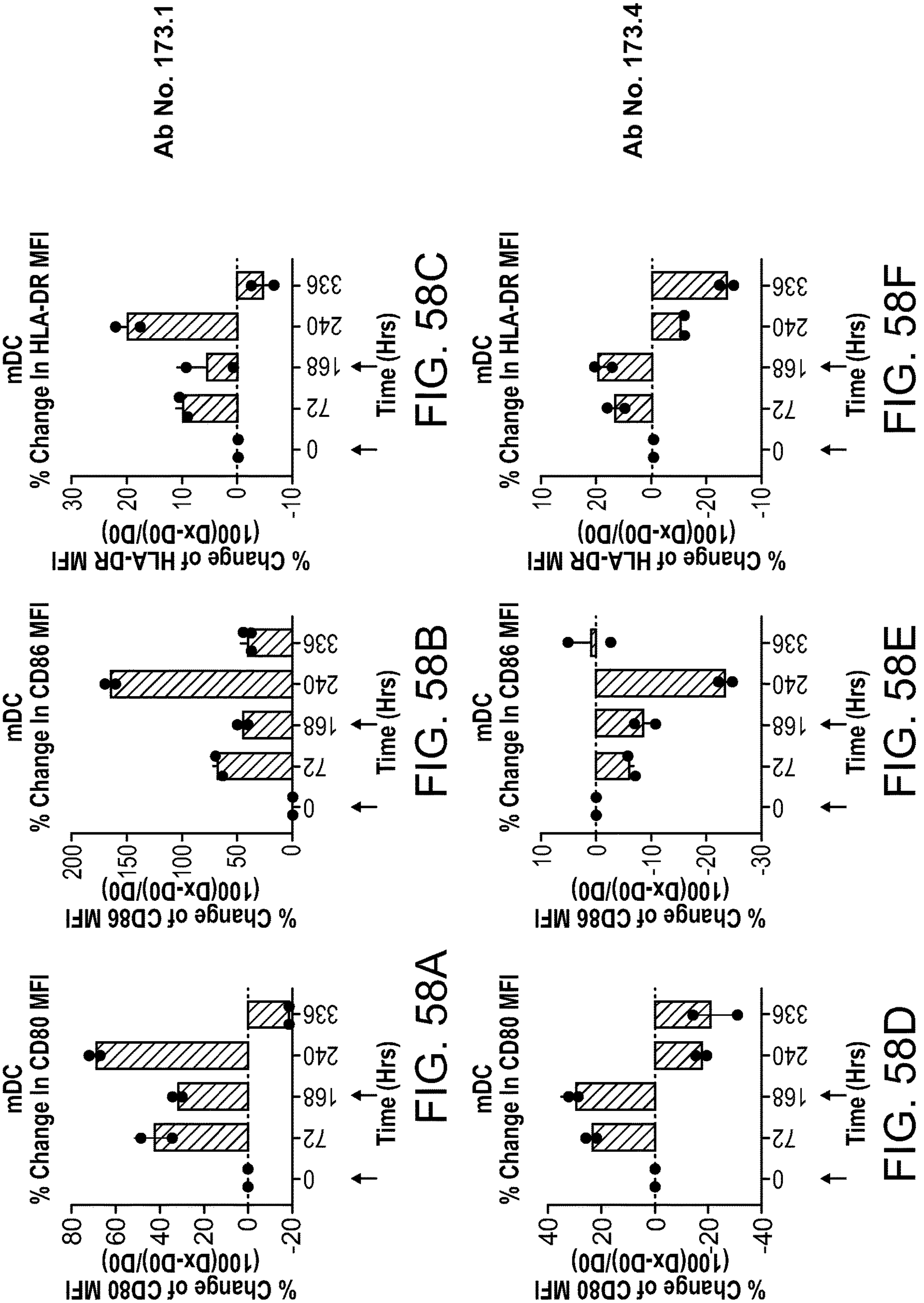
Figure 58G:
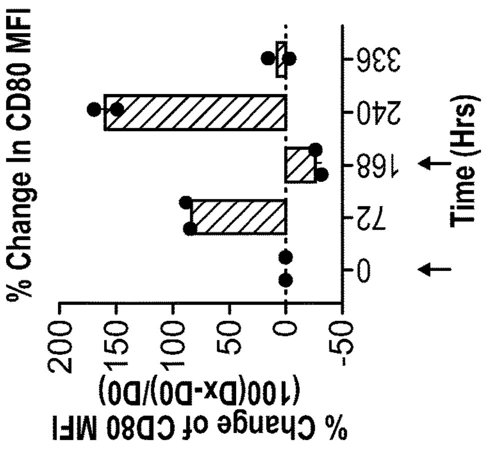
Figure 58H:
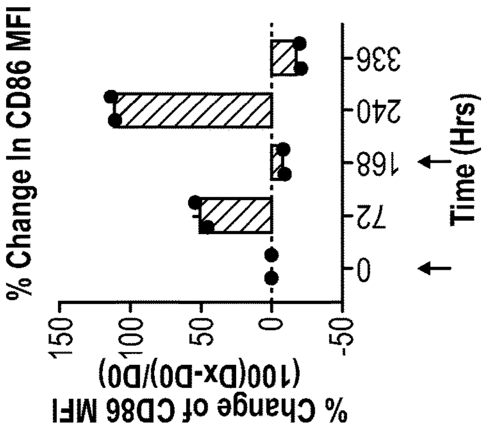
Figure 58I:
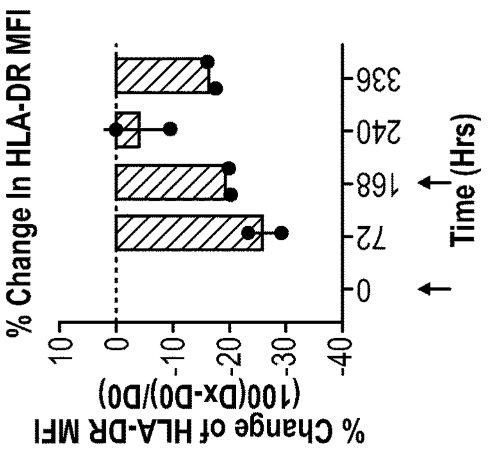
Figure 58J:
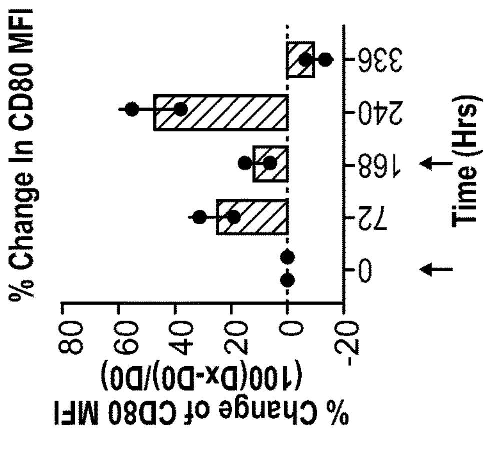
Figure 58K:
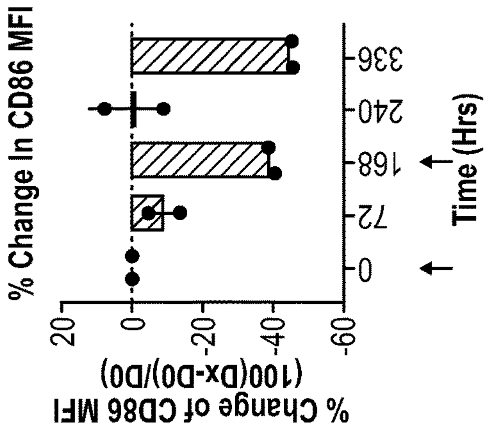
Figure 58L:
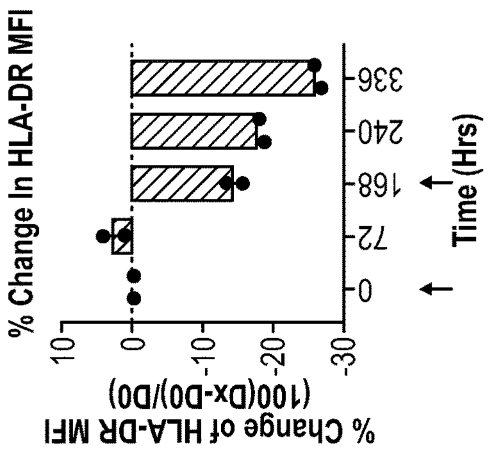
Figures 58M, 58N, 58O, 58P, 58Q, 58R:
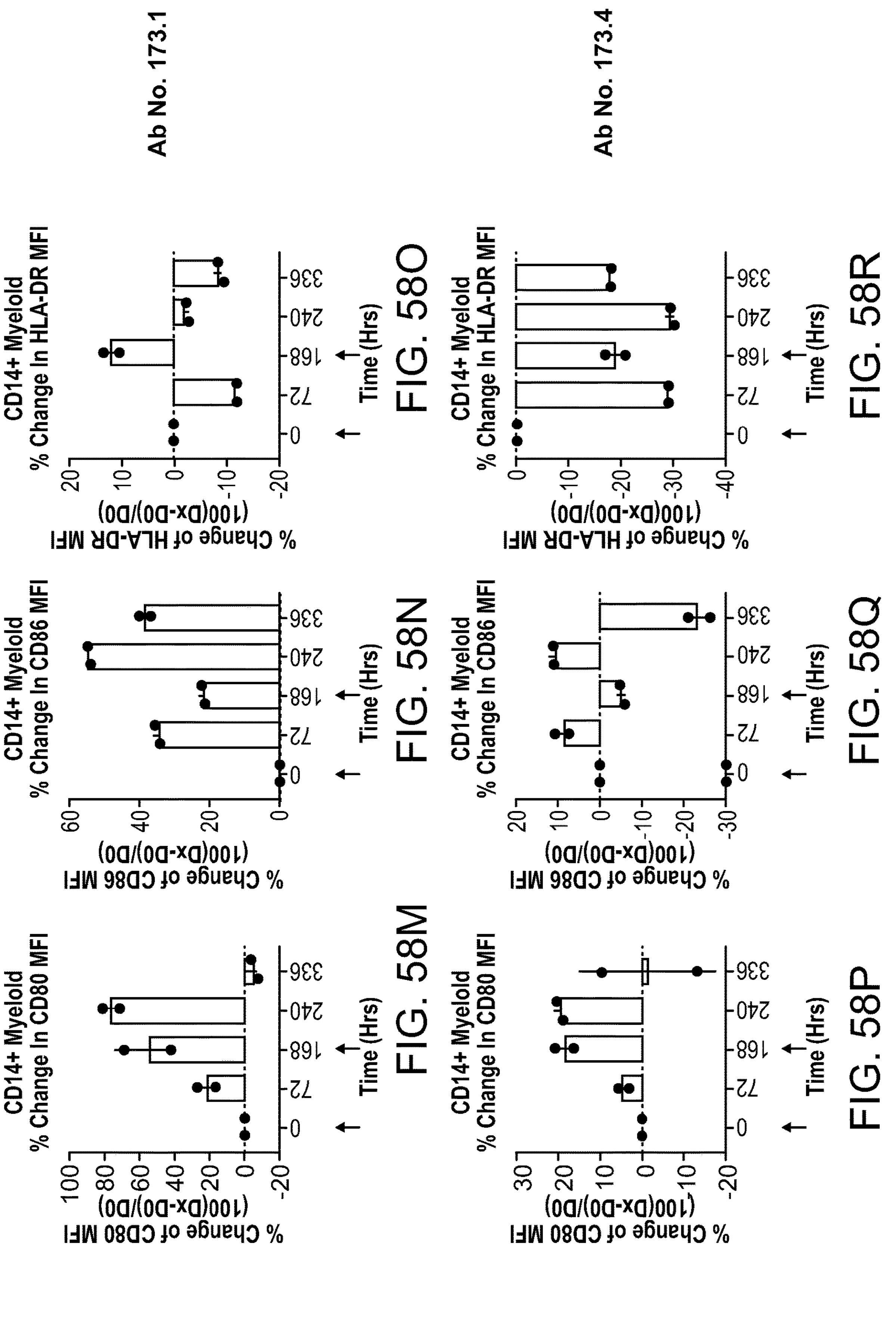
Figures 58S, 58T, 58U, 58V, 58W, 58X:
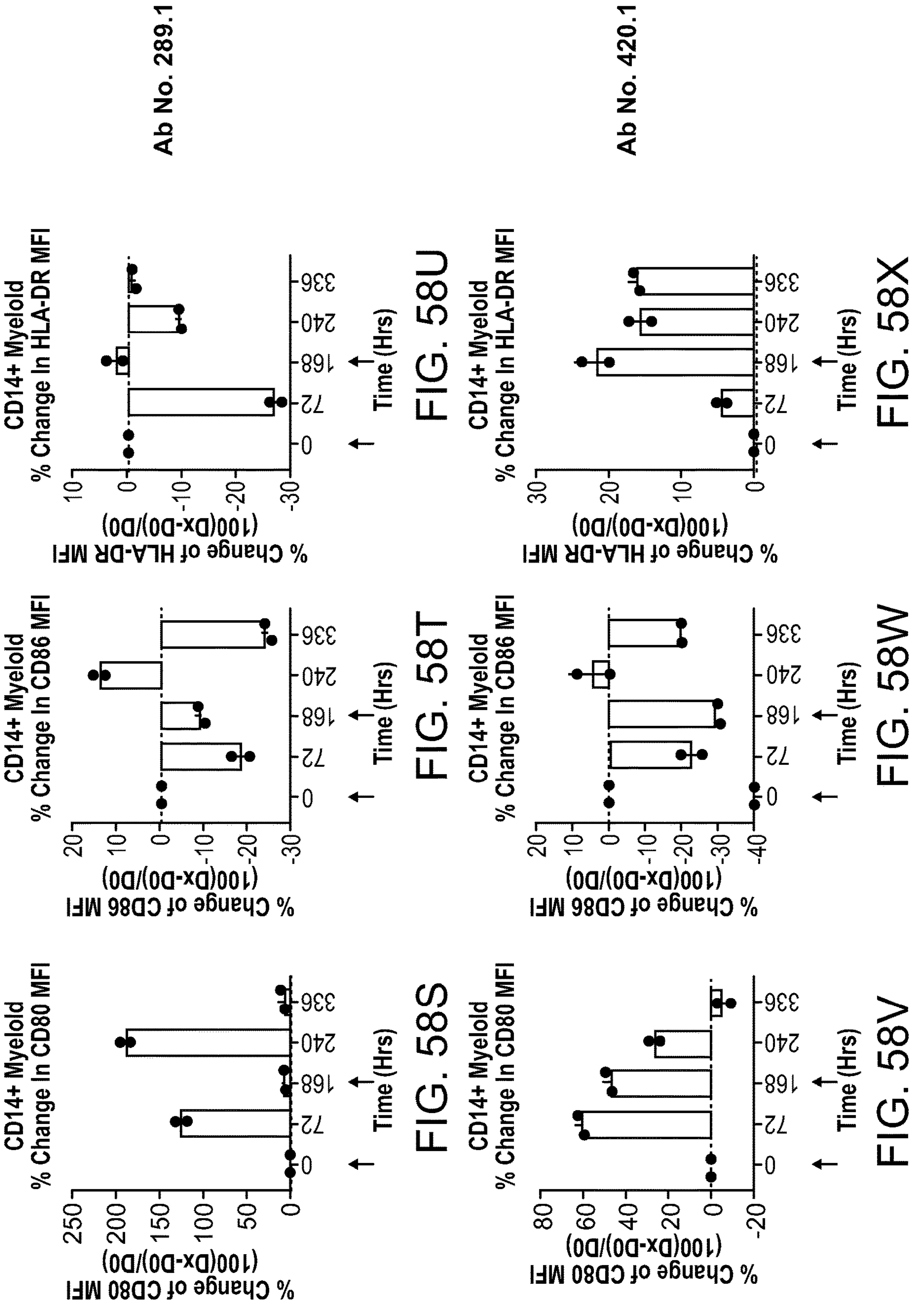

FIG. 58A-58X: Changes in myeloid dendritic cell (mDC) and CD14+ monocyte activation markers during non-human primate (NHP) in vivo exposure to anti-VISTA antibodies. Graphs of % change in activation marker mean fluorescence intensity (MFI) relative to pre-dose as identified by ex vivo flow cytometry analysis. Samples from all time points (0 h (pre-dose), 72 h, 168 h (pre-2nd dose), 240 h, and 336 h) were thawed, stained, and analyzed on the same day for determination of myeloid population size and activation markers. The CD45+CD66-CD3-CD8-CD20−, Side Scatter intermediate myeloid population was gated for CD14+ monocytes or CD14-HLA−DR+CD1c+ or CD11c+CD123− myeloid dendritic cells (mDC). MFI of CD80, CD86, and HLA-DR of CD14+ monocytes and mDC were acquired on technical duplicates, and MFI from the respective Fluorescence Minus One (FMO) samples were subtracted. (A Fluorescence Minus One (FMO) control is a sample where cells are stained with all but one of the fluorochromes used in the experiment, with one FMO control for each fluorochrome, to determine the cut-off point between background fluorescence and positive populations.) Percentage change in MFI relative to pre-dose levels was calculated as % change=100*(MFI Day x−MFI Day 0)/MFI Day 0. Results for samples of in vivo dosed animals are presented for antibody No. 173.1 (WT); antibody No. 173.4 (WT); antibody No. 289.1 (LS); and antibody No. 420.1 (YTE). Graphs show the changes in expression levels of activation markers CD80 (FIGS. 58A, 58D, 58G, 58J, 58M, 58P, 58S and 58V); CD86 (FIGS. 58B, 58E, 58H, 58K, 58N, 58Q, 58T, and 58W); and HLA-DR (FIGS. 58C, 58F, 58I, 58L, 58O, 58R, 58U and 58X). Arrows indicate 10 mg/kg iv dosing at 0 and 168 hours. Antibodies tested are shown on the x-axes.

Figures 59A, 59B, 59C, 59D:
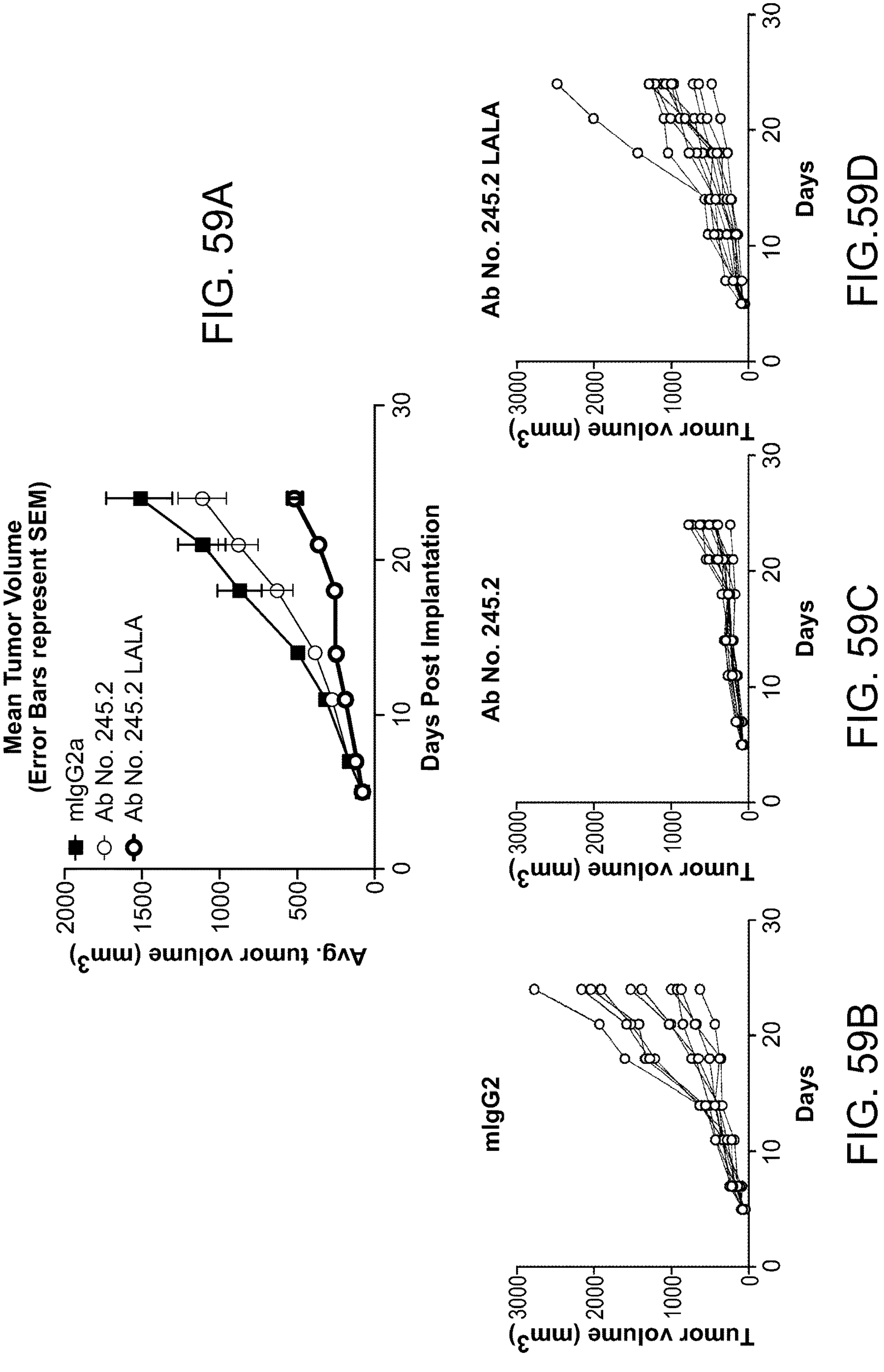
Figures 59E, 59F, 59G, 59H:
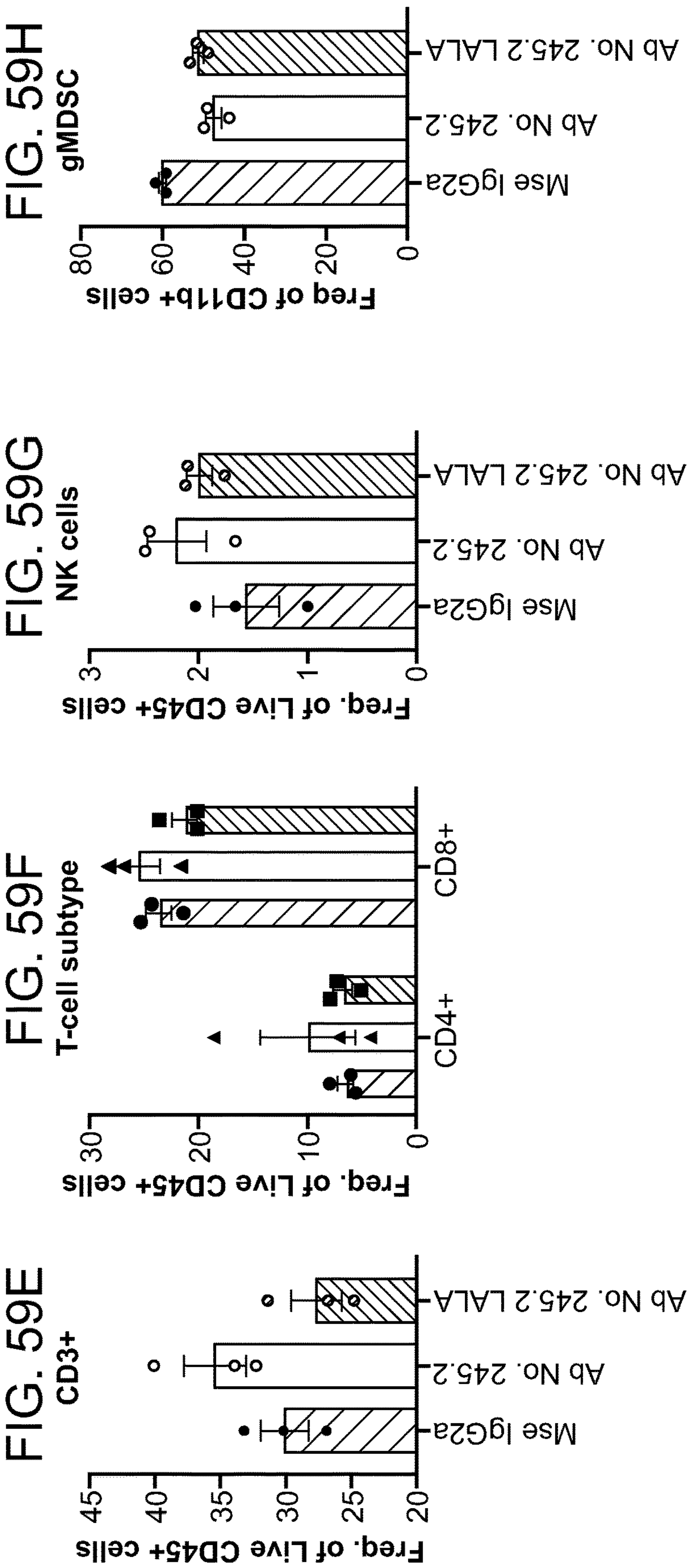

FIGS. 59A-59D. In vivo anti-tumor efficacy of anti-VISTA antibody No. 245.2 in an MB49 tumor model in human VISTA KI mice. VISTA KI mice were injected subcutaneously with $5\times10^5$ MB49 cells and randomized after tumor volumes reached approximately 70 $mm^3$. Mice were treated by intraperitoneal (IP) injection with 30 mg/kg mouse IgG2a control antibody, 30 mg/kg of antibody No. 245.2 or 30 mg/kg antibody No. 245.2 with L234A and L235A substitutions according to EU numbering (“LALA”) twice per week for a total of six doses. Tumor volumes were measured twice per week in two dimensions using a caliper, and the volume was expressed in $mm^3$ using the formula: “$V=(L\times W\times W)/2$,” where V is tumor volume, L is tumor length (the longest tumor dimension) and W is tumor width (the longest tumor dimension perpendicular to L). FIG. 59A shows mean tumor volume±SEM for IgG2a control (square), 245.2 (open circle) and 245.2 LALA (closed circle). FIGS. 59B-59D show individual tumor measurements over time for each animal and each group.

FIGS. 59E-59H. Tumor infiltrating lymphocytes—Lymphoid panel. Tumors were harvested from hVISTA KI C57B/6 mice treated with mIgG 2a (30 mg/kg), Ab No. 245.2-LALA (30 mg/kg) and Ab No. 245.2 (30 mg/kg) (n=3) on the 3rd day after final dose (dose #6) on day 24. The tumors were dissociated using Miltenyi Tumor disassociation kit (Cat #130-096-730) and octoMACS. The cells were then stained with lymphoid panel and then RBC were lysed with Biolegend RBS Lysis buffer (CAT #420301) and analyzed via flow cytometry on Attune Nxt instrument.

Figure 60A:
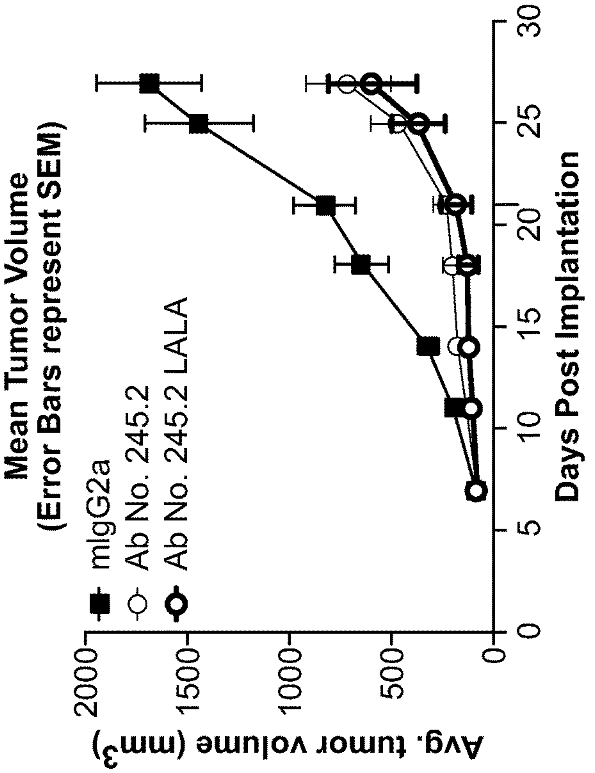
Figure 60B:
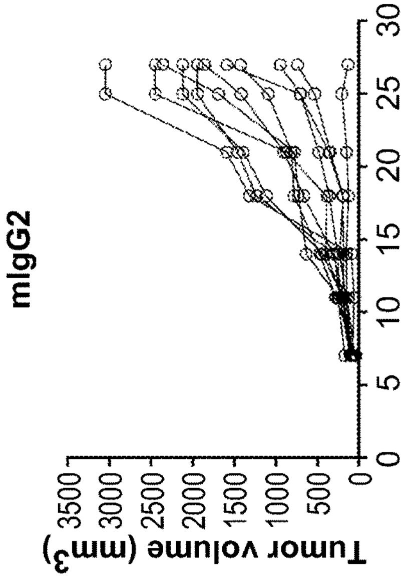
Figure 60C:
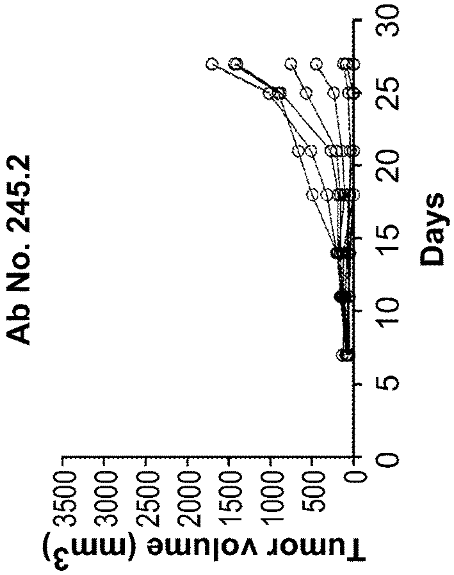
Figure 60D:
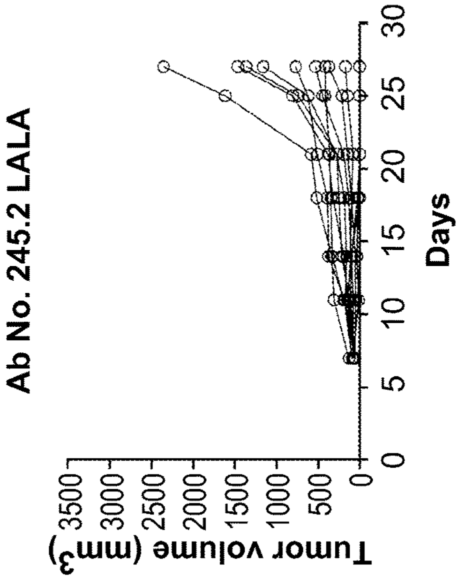

FIGS. 60A-60D. In vivo anti-tumor efficacy of anti-VISTA antibody No. 245.2 in an E.G7-OVA tumor model in human VISTA KI mice. VISTA KI mice were injected subcutaneously with $1\times10^6$ E.G7-OVA cells and randomized after tumor volumes reached approximately 70 $mm^3$. Mice were treated by intraperitoneal (IP) injection with 30 mg/kg control antibody (mouse IgG2a), 30 mg/kg of antibody No. 245.2 or 30 mg/kg antibody No. 245.2 LALA twice per week for a total of six doses. Tumor volumes were measured twice per week in two dimensions using a caliper, and the volume was expressed in $mm^3$ using the formula: “$V=(L\times W\times W)/2$,” where V is tumor volume, L is tumor length (the longest tumor dimension) and W is tumor width (the longest tumor dimension perpendicular to L). FIG. 60A shows mean tumor volume±SEM for IgG2a control (square), 245.2 (open circle) and 245.2 LALA (closed circle). FIGS. 60B-60D show individual tumor measurements over time for each animal and each group.

DETAILED DESCRIPTION

Provided herein are antibodies and an antigen-binding fragments thereof that specifically bind to VISTA, which antibodies and fragments are also referred to herein as “anti-VISTA antibodies” and “anti-VISTA antigen-binding fragments,” respectively. As used herein, the terms “immunospecifically binds,” “immunospecifically recognizes,” “specifically binds,” and “specifically recognizes” are used interchangeably in the context of antibodies and antigen-binding fragments thereof, to refer to binding by antibodies and antigen-binding fragments to an antigen via the antigen-binding sites of the antibody, as will be understood by one skilled in the art, and does not exclude cross-reactivity of the antibody or antigen-binding fragment with other antigens. For example, an antibody or antigen-binding fragment thereof provided herein may immunospecifically bind to both human VISTA and cynomolgus monkey VISTA, but not mouse VISTA. Any method known in the art can be used to ascertain whether immunospecific binding to VISTA occurs.

Antibodies described herein may be monoclonal antibodies or polyclonal antibodies, and preferably are monoclonal antibodies. In specific embodiments, an antibody or an antigen-binding fragment thereof that specifically binds to VISTA is an immunoglobulin, a tetrameric antibody comprising two heavy chains and two light chains, an antibody light chain monomer, an antibody heavy chain monomer, an antibody light chain dimer, an antibody heavy chain dimer, an antibody light chain-antibody heavy chain pair, a single domain antibody, a monovalent antibody, a single chain antibody, a single-chain Fv (scFv), or a disulfide-linked Fv. For purposes of this disclosure, a scFv shall be considered an antigen-binding fragment, since a scFv comprises VH and VL domains (connected by a linker).

In certain embodiments, an antibody or an antigen-binding fragment thereof that specifically binds to VISTA described herein is bivalent. In certain embodiments, an antibody or an antigen-binding fragment thereof that specifically binds to VISTA described herein is multispecific or bispecific. In certain embodiments, an antibody that specifically binds to VISTA described herein is a bispecific monoclonal antibody. In certain embodiments, an antibody described herein is monovalent. In specific embodiments, an antibody or an antigen-binding fragment thereof that specifically binds to VISTA described herein is bivalent. In specific embodiments, an antibody or an antigen-binding fragment thereof that specifically binds to VISTA described herein is monospecific. In certain embodiments, an antibody or an antigen-binding fragment thereof that specifically binds to VISTA described herein is recombinantly produced. In certain embodiments, an antibody or an antigen-binding fragment thereof that specifically binds to VISTA described herein is purified. In specific embodiments, an antibody that specifically binds to VISTA described herein is a synthetic antibody. In specific embodiments an antibody that specifically binds to VISTA described herein is a human antibody.

In certain embodiments, an antibody that specifically binds to VISTA described herein is a murine antibody.

In a specific embodiment of the antibodies of the invention, the antibody is an immunoglobulin. The antibodies described herein can be of any type (e.g., IgG, IgE, IgM, IgD, IgA, IgW or IgY), any class (e.g., $IgG_1$, $IgG_2$, $IgG_3$, $IgG_4$, $IgA_1$ or $IgA_2$), or any subclass (e.g., $IgG_{2a}$ or $IgG_{2b}$) of immunoglobulin molecules. In certain embodiments, an antibody that specifically binds to VISTA described herein is an IgG antibody, or a class or subclass thereof. In specific embodiments, an antibody that specifically binds to VISTA described herein is a monoclonal antibody. In specific embodiments, an antibody that specifically binds to VISTA described herein is an IgG antibody. In specific embodiments, an antibody that specifically binds to VISTA described herein is an IgG1 antibody. In another specific embodiment, an antibody that specifically binds to VISTA described herein is an IgG2 antibody. In another specific embodiment, an antibody that specifically binds to VISTA described herein is an IgG3 antibody. In another specific embodiment, an antibody that specifically binds to VISTA described herein is an IgG4 antibody.

In a specific embodiment, an antibody that specifically binds to VISTA described herein or an antigen-binding fragment thereof is formed by an association of a heavy chain and a light chain, or by an association of a heavy chain variable region and a light chain variable region.

An antigen-binding fragment binds to an antigen and comprises the portion of an antibody molecule that comprises the amino acid residues that confer on the antibody molecule its specificity for the antigen (e.g., the complementarity determining regions (CDRs)) surrounded by framework regions. The CDRs can be derived from any animal species, such as, for example, rodents (e.g., mouse, rat or hamster), chicken, cows, camels, and humans. By way of example, antigen-binding fragments include Fab fragments, $F(ab')_2$ fragments, and other antigen binding fragments of any of the antibodies described herein.

As used herein, the terms "variable region" or "variable domain" are used interchangeably and are common in the art. The variable region typically refers to a portion of an antibody, generally, a portion of a light or heavy chain, which differs extensively in sequence among antibodies and is used in the binding and specificity of a particular antibody for its particular antigen. The variability in sequence is concentrated in the CDRs, while the more highly conserved regions in the variable domain are called framework regions. Without wishing to be bound by any particular mechanism or theory, it is believed that the CDRs of the light and heavy chains are primarily responsible for the interaction and specificity of the antibody with an antigen;

CDRs are defined in various ways in the art, including the Kabat, Chothia, AbM, contact, IMGT, and Paratome numbering systems. Any of the CDR numbering systems known in the art can be used to define the CDRs of the anti-VISTA antibodies disclosed herein. The Kabat numbering system is based on sequence variability and is the most commonly used definition to predict CDR regions (Kabat, Elvin A. et al., Sequences of Proteins of Immunological Interest. Bethesda: National Institutes of Health, 1983). The Chothia numbering system is based on the location of the structural loop regions (Chothia et al., (1987) J Mol Biol 196: 901-917). The AbM numbering system, a compromise between the Kabat and Chothia numbering systems, is an integral suite of programs for antibody structure modeling produced by the Oxford Molecular Group (bioinf.org.uk/abs) (Martin A C R et al., (1989) PNAS 86: 9268-9272). The contact numbering system is based on an analysis of the available complex crystal structures (bioinf.org.uk/abs) (see MacCallum R M et al., (1996) J Mol Biol 5: 732-745). The IMGT numbering system is from the IMGT ("IMGT®, the international ImMunoGeneTics information System® website imgt.org, founder and director: Marie-Paule Lefranc, Montpellier, France). The Paratome numbering system predicts the antigen-binding region of an antibody based on a set of consensus regions derived from a structural alignment of a non-redundant set of all known antibody-antigen complexes. The algorithm is based on the premise that the vast majority of antigen-binding residues lie in regions of structural consensus between antibodies, which form six sequence stretches in the antibody sequence, roughly corresponding to the six CDRs (see Kunit et al., Nucleic Acids Research, 2012, Vol. 40, Web Server issue W521-W524).

The present disclosure not only provides antibodies and antigen-binding fragments and other subject matter (e.g., scFv, CDRs, variable regions, etc.) that comprise the sequences disclosed herein, but also antibodies and antigen-binding fragments and other subject matter that consist or consist essentially of the sequences disclosed herein.

In another aspect, provided herein are multispecific antibodies and heteroconjugate antibodies. In specific embodiments, provided herein is a bispecific antibody which comprises two different antigen binding regions, wherein one of the binding regions binds VISTA, and comprises a variable heavy chain region, a variable light chain region or both, of an antibody described herein, and the other binding region binds to a different antigen of interest. In a specific aspect, provided herein is a bispecific antibody comprising two different antigen binding regions, wherein one of the binding regions specifically binds to VISTA and the other binding region binds to another antigen of interest, and wherein the binding region that specifically binds to VISTA is an antibody or an antigen-binding fragment thereof that specifically binds to VISTA described herein. In a specific aspect, provided herein is a bispecific antibody comprising a first variable region containing two antigen binding sites (i.e., it is bivalent) that specifically bind to VISTA, and a second variable region containing two binding sites (i.e., it is bivalent) that specifically bind to a different antigen, wherein the first and the second variable regions are linked by an Fc fragment; in a specific embodiment of this aspect, the variable regions are each Fab regions.

In particular embodiments, an antibody or antigen-binding fragment thereof that specifically binds to VISTA described herein is a bispecific antibody or a trispecific antibody. In specific embodiments, provided herein is a bispecific antibody comprising two different antigen binding regions, wherein one of the binding regions specifically binds to VISTA and the other binding region binds to another antigen of interest, and wherein the binding region that specifically binds to VISTA comprises the variable heavy chain region of an antibody or an antigen-binding fragment thereof that specifically binds to VISTA described herein. In specific embodiments, provided herein is a bispecific antibody comprising two different antigen binding regions, wherein one of the binding regions specifically binds to VISTA and the other binding region binds to another antigen of interest, and wherein the binding region that specifically binds to VISTA comprises the VH of an antibody set forth in Table 7, and optionally a VL. In another specific embodiment, provided herein is a bispecific antibody comprising two different antigen binding regions, wherein one of the binding regions specifically binds to VISTA and the other binding region binds to another antigen of interest, and wherein the binding region that specifically binds to VISTA comprises the VH of an antibody set forth in Table 7 and the VL of the same antibody set forth in Table 8. In one embodiment, the binding region that specifically binds to VISTA is a scFv. In certain embodiments, the antigen of interest to which the other binding region of a bispecific antibody described herein binds is antigen present on an immune cell (e.g., a T cell, an NK cell, or dendritic cell). In specific embodiments, an antibody provided herein is a bispecific T cell engager (BiTE). Several different formats of multispecific antibodies have been described, see, e.g., Brinkman and Kontermann, MABS 2017, 9(2): 182-212.

Also provided herein is fusion protein comprising an antibody or antigen-binding fragment that specifically binds to VISTA described herein. In specific embodiments, a fusion protein comprises the VH and the VL of an antibody or antigen-binding fragment that specifically binds to VISTA described herein. Also provided herein are fusion proteins comprising an scFv comprising an antibody or antigen-binding fragment that specifically binds to VISTA described herein. In specific embodiments, an scFv comprises a VH and a VL separated by a linker sequence, wherein the VH comprises a VH CDR1, a VH CDR2 and a VH CDR3, the VH CDR1 is of the SEQ ID NO: set forth in a table selected from the group consisting of Tables 1-3 as the VH CDR1 for an Antibody No. listed in said table, and the VH CDR2 is of the SEQ ID NO: set forth in said table as the VH CDR2 for said antibody, and the VH CDR3 is of the SEQ ID NO: set forth in said table as the VH CDR3 for said antibody. In specific embodiments, the scFv comprises a VH and a VL separated by a linker sequence, wherein (i) the VH comprises a VH CDR1, a VH CDR2 and a VH CDR3, the VH CDR1 is of the SEQ ID NO: set forth in a table selected from the group consisting of Tables 1-3 as the VH CDR1 for an Antibody No. listed in said table, and the VH CDR2 is of the SEQ ID NO: set forth in said table as the VH CDR2 for said antibody, and the VH CDR3 is of the SEQ ID NO: set forth in said table as the VH CDR3 for said antibody, and (ii) the VL comprises a VL CDR1, a VL CDR2 and a VL CDR3, and wherein the VL CDR1 is of the SEQ ID NO: set forth in a table selected from the group consisting of Tables 4-6 as the VL CDR1 for said antibody, the VL CDR2 is of the SEQ ID NO: set forth in said table as the VL CDR2 for said antibody, and the VL CDR3 is of the SEQ ID NO: set forth in said table as the VL CDR3 for said antibody, wherein the VL CDR1, VL CDR2, VL CDR3, VH CDR1, VH CDR2 and VH CDR3 all are defined by the same CDR numbering system. In particular embodiments, an scFv comprises a VH and a VL, wherein the VH comprises the SEQ ID NO: set forth in Table 7 as the VH of said antibody. In particular embodiments, an scFv comprises a VH and a VL, wherein (i) the VH comprises the SEQ ID NO: set forth in Table 7 as the VH of said antibody and (ii) the VL comprises the SEQ ID NO: set forth in Table 8 as the VL of said antibody.

Further provided herein is a chimeric antigen receptor (CAR) comprising a scFv comprising an antibody or antigen-binding fragment that specifically binds to VISTA described herein, and a cell containing a nucleic acid encoding the CAR, including a cell expressing the CAR. In a specific embodiment, the cell contains a recombinant nucleic acid encoding the CAR, such that the cell expresses the CAR. In a specific embodiment, the cells are ex vivo.

The structures of "first generation," "second generation" and "third generation" CARs have been described in the art (see, for example, Jensen et al., *Immunol. Rev.* 257:127-133 (2014); Sharpe et al., *Dis. Model Mech.* 8(4):337-350 (2015); Brentjens et al., *Clin. Cancer Res.* 13:5426-5435 (2007); Gade et al., *Cancer Res.* 65:9080-9088 (2005); Maher et al., *Nat. Biotechnol.* 20:70-75 (2002); Kershaw et al., *J. Immunol.* 173:2143-2150 (2004); Sadelain et al., *Curr. Opin. Immunol.* 21(2):215-223 (2009); Hollyman et al., *J. Immunother.* 32:169-180 (2009)).

In a specific embodiment, the CAR is a "first generation" CAR comprising an extracellular antigen-binding fragment that specifically binds to VISTA described herein (e.g., a scFv that specifically binds to VISTA described herein) fused to a transmembrane domain, which is fused to a cytoplasmic/intracellular domain of a T cell receptor complex chain. In a specific embodiment, the cytoplasmic domain is the intracellular domain of the CD3 chain.

In a specific embodiment, the CAR is a "second-generation" CAR comprising an antigen-binding fragment that specifically binds to VISTA described herein (e.g., a scFv that specifically binds to VISTA described herein) fused to a transmembrane domain, which is fused to a co-stimulatory domain for enhancing the potency and persistence of immune cells (e.g., T cells), which is fused to an intracellular signaling domain that can activate immune cells (e.g., the intracellular domain of the CD3ζ chain) (see Sadelain et al., *Cancer Discov.* 3:388-398 (2013)). The co-stimulatory domain of a "second generation" CAR may be an intracellular domain from any of various co-stimulatory molecules, for example, the co-stimulatory domain of CD28, 4-1BB, ICOS, or OX40. Thus, "second generation" CARs afford both co-stimulation (e.g., by CD28 or 4-IBB intracellular domains), and activation (e.g., by a CD3ζ (signaling domain).

"Third generation" CARs comprise the structure of a second generation CAR but with multiple (e.g., two) co-stimulatory domains. Thus, third generation CARs afford multiple co-stimulation, e.g., by comprising both CD28 and 4-1BB intracellular domains, and activation, e.g., by comprising a CD3ζ activation domain.

In specific embodiments, the CARs of the invention comprise an extracellular antigen binding domain, a transmembrane domain and an intracellular domain, as described above, where the extracellular antigen binding domain is an scFv comprising an antibody or antigen-binding fragment that specifically binds to VISTA described herein. In specific embodiments, the intracellular domain is a CD3ζ signaling domain.

In specific embodiments, the cell comprising a CAR is a T cell. In other specific embodiments, the cell comprising a CAR is a natural killer (NK) cell. In other specific embodiments, the cell comprising a CAR is a macrophage. Examples of cells that may express CARs have been described, see, e.g., Basar et al., Hematology 2020 ASH Education Program pp. 570-578; Villanueva 2020, Nat. Rev. Drug Discov. Vol. 20:300; Mukhopadhyay 2020; Nat. Methods Vol. 17:561; Anderson et al., 2017, Cancer Res (published online Nov. 17, 2020); Cortez-Selva et al., 2021, Trends in Pharmacological Sciences 42 (1):45-59; Klichinsky et al., 2020, Nat. Biotech. 38:947-959; Vacca et al., 2020, Front. Immunol. 10:3013 doi: 10.3389/fimmu.2019.03013; and Xie et al., 2020, EBioMedicine 59:102975.

Also provided herein is an antibody-drug conjugate comprising an antibody or antigen-binding fragment or scFv that specifically binds to VISTA described herein bound (e.g., covalently bound) to a therapeutic agent. In specific embodiments, the therapeutic agent is a cytotoxic agent. In specific embodiments, provided herein is an antibody-drug conjugate comprising a fusion protein comprising an antibody or antigen-binding fragment that specifically binds to VISTA described herein.

In another specific embodiment, provided are antibody-drug conjugates comprising an antibody or antigen-binding fragment or scFv that specifically binds to VISTA described herein bound to a label or an imaging agent, for use in detection and/or measuring and/or localization of VISTA levels in vivo or ex vivo (e.g., in a biopsy tumor sample from a patient), by contacting an ex vivo cell sample (e.g. a biopsy tumor sample) or administering to the patient the antibody and detecting binding via the label or imaging agent. In a specific embodiment, such a method is used to determine whether a patient is indicated for cancer treatment with the anti-VISTA antibodies and antigen-binding fragment and antibody-drug conjugates (bound to a therapeutic agent) of the invention by determining that the patient's cancer is VISTA-positive or expresses VISTA at desired levels.

1.1 Antibodies

For each of the Antibody Numbers (each respective "Antibody [or Ab] No.") used to identify a particular antibody in the present disclosure, the number after the period in the Antibody Number indicates the IgG class of the antibody. Thus, for example, Ab No. 173.1 is an IgG1 antibody, whereas Ab No. 173.4 is an IgG4 antibody.

Sequences and Variants

Provided in Table 1-Table 6 infra, are VH CDRs and VL CDRs of antibodies or antigen-binding fragments thereof that specifically binds to VISTA as defined using different numbering systems (Kabat, IMGT and Paratome). Table 1-Table 3 infra, provide VH CDRs as defined using different systems which may be combined with the VL CDRs in Table 4-Table 6. In specific embodiments, the VH CDRs for one antibody (e.g., Antibody No. 269.1) in Table 1 are combined with the VL CDRs for the same antibody (e.g., 269.1) in Table 4. In a specific embodiment, the VH CDRs for one antibody (e.g., Antibody No. 269.1) in Table 2 are combined with the VL CDRs for the same antibody (e.g., Antibody No. 269.1) in Table 5. In specific embodiments, the VH CDRs for one antibody (e.g., Antibody No. 269.1) in Table 3 are combined with the VL CDRs for the same antibody (e.g., Antibody No. 269.1) in Table 6.

In specific embodiments, an antibody or an antigen-binding fragment thereof that specifically binds to VISTA comprises a VH and a VL, wherein the VH comprises a VH CDR1, a VH CDR2 and a VH CDR3, and wherein the VH CDR1 is of the SEQ ID NO: set forth in Table 1 as the VH CDR1 for an Antibody No. listed in Table 1, and the VH CDR2 is of the SEQ ID NO: set forth in Table 1 as the VH CDR2 for said antibody, and the VH CDR3 is of the SEQ ID NO: set forth in Table 1 as the VH CDR3 for said antibody. In particular embodiments, an antibody or an antigen-binding fragment thereof that specifically binds to VISTA comprises a VH and a VL, wherein (i) the VH comprises a VH CDR1, a VH CDR2 and a VH CDR3, and wherein the VH CDR1 is of the SEQ ID NO: set forth in Table 1 as the VH CDR1 for an Antibody No. listed in Table 1, and the VH CDR2 is of the SEQ ID NO: set forth in Table 1 as the VH CDR2 for said antibody, and the VH CDR3 is of the SEQ ID NO: set forth in Table 1 as the VH CDR3 for said antibody and (ii) the VL comprises a VL CDR1, a VL CDR2 and a VL CDR3, and wherein the VL CDR1 is of the SEQ ID NO: set forth in Table 4 as the VL CDR1 for said antibody, the VL CDR2 is of the SEQ ID NO: set forth in Table 4 as the VL CDR2 for said antibody, and the VL CDR3 is of the SEQ ID NO: set forth in Table 4 as the VH CDR3 for said antibody In specific embodiments, an antibody or an antigen-binding fragment thereof that specifically binds to VISTA comprises a VH and a VL, wherein the VH comprises a VH CDR1, a VH CDR2 and a VH CDR3, and wherein the VH CDR1 is of the SEQ ID NO: set forth in Table 2 as the VH CDR1 for an Antibody No. listed in Table 2, and the VH CDR2 is of the SEQ ID NO: set forth in Table 2 as the VH CDR2 for said antibody, and the VH CDR3 is of the SEQ ID NO: set forth in Table 2 as the VH CDR3 for said antibody. In particular embodiments, an antibody or an antigen-binding fragment thereof that specifically binds to VISTA comprises a VH and a VL, wherein (i) the VH comprises a VH CDR1, a VH CDR2 and a VH CDR3, and wherein the VH CDR1 is of the SEQ ID NO: set forth in Table 2 as the VH CDR1 for an Antibody No. listed in Table 2, and the VH CDR2 is of the SEQ ID NO: set forth in Table 2 as the VH CDR2 for said antibody, and the VH CDR3 is of the SEQ ID NO: set forth in Table 2 as the VH CDR3 for said antibody, and (ii) the VL comprises a VL CDR1, a VL CDR2 and a VL CDR3, and wherein the VL CDR1 is of the SEQ ID NO: set forth in Table 5 as the VL CDR1 for said antibody, the VL CDR2 is of the SEQ ID NO: set forth in Table 5 as the VL CDR2 for said antibody, and the VL CDR3 is of the SEQ ID NO: set forth in Table 5 as the VL CDR3 for said antibody In specific embodiments, an antibody or an antigen-binding fragment thereof that specifically binds to VISTA comprises a VH and a VL, wherein (i) the VH comprises a VH CDR1, a VH CDR2 and a VH CDR3, and wherein the VH CDR1 is of the SEQ ID NO: set forth in Table 3 as the VH CDR1 for an Antibody No. listed in Table 3, and the VH CDR2 is of the SEQ ID NO: set forth in Table 3 as the VH CDR2 for said antibody, and the VH CDR3 is of the SEQ ID NO: set forth in Table 3 as the VH CDR3 for said antibody, and (ii) the VL comprises a VL CDR1, a VL CDR2 and a VL CDR3, and wherein the VL CDR1 is of the SEQ ID NO: set forth in Table 6 as the VL CDR1 for said antibody, the VL CDR2 is of the SEQ ID NO: set forth in Table 6 as the VL CDR2 for said antibody, and the VL CDR3 is of the SEQ ID NO: set forth in Table 6 as the VL CDR3 for said antibody.

TABLE 1

VH CDRs as defined by Kabat numbering system.

| Antibody No. | VH CDR1 | VH CDR2 | VH CDR3 |
|---|---|---|---|
| 269.1, 141.1, 184.1, 308.1 | SYGMH (SEQ ID No: 247) | DIWYDGSNKHYADSVKG (SEQ ID No: 254) | ESDYERPYFYYGMDV (SEQ ID No: 266) |
| 321.1, 405.1, 472.1 | SSGYYWG (SEQ ID No: 248) | SLYSSGYTYYNPSLKS (SEQ ID No: 255) | HPVAMNFDD (SEQ ID No: 267) |
| 245.1, 475.1, 149.1, 133.1, 245.2, 245.4 | SYYWS (SEQ ID No: 249) | YIYYSGSTNYNPSLKS (SEQ ID No: 256) | DIPAFAFDI (SEQ ID No: 268) |

TABLE 1-continued

VH CDRs as defined by Kabat numbering system.

| Antibody No. | VH CDR1 | VH CDR2 | VH CDR3 |
|---|---|---|---|
| 465.1, 341.1, 228.1, 444.1, 395.1, 465.4 | SYAMN (SEQ ID No: 250) | AISGSGGITYYADSVKG (SEQ ID No: 257) | DWELGRFDY (SEQ ID No: 269) |
| 457.1, 266.1, 329.1, 426.1 | SYAMS (SEQ ID No: 251) | VISGSGGITYYSDSVKG (SEQ ID No: 258) | DWEFFWYFDL (SEQ ID No: 270) |
| 173.1, 267.1, 102.1, 420.1, 289.1, 374.1, 394.1, 213.1, 219.1, 380.1, 173.4, 380.4, 420.4, 371.4, 289.4 | SSGYYWG (SEQ ID No: 248) | SIFYSGNTHYNPSLKS (SEQ ID No: 259) | RDILTGPFDY (SEQ ID No: 271) |
| 244.1, 244.2, 244.4 | SYGMH (SEQ ID No: 247) | DIWYDGSNKHYADSVKG (SEQ ID No: 254) | ESDYERPYFYYGMDV (SEQ ID No: 266) |
| 5DA | SSGYYWG (SEQ ID No: 248) | SLYSSGYTYYNPSLKS (SEQ ID No: 255) | HPVAMNFDD (SEQ ID No: 267) |
| 474.1, 373.1, 467.1, 908.1, 386.1, 268.1, 342.1, 259.1, 474.2, 542.2, 474.4, 150.1, 246.4 | SYYWS (SEQ ID No: 249) | YIYYSGSTNYNPSLKS (SEQ ID No: 256) | DIPAFAFDI (SEQ ID No: 268) |
| 564.2, 564.4 | SYAMN (SEQ ID No: 250) | AISGSGGITYYADSVKG (SEQ ID No: 257) | DWELGRFDY (SEQ ID No: 269) |
| 195.1, 195.2, 195.4 | SYAMS (SEQ ID No: 251) | VISGSGGITYYSDSVKG (SEQ ID No: 258) | DWEFFWYFDL (SEQ ID No: 270) |
| 410.1, 410.2, 410.4 | SSGYYWG (SEQ ID No: 248) | SIFYSGNTHYNPSLKS (SEQ ID No: 259) | RDILTGPFDY (SEQ ID No: 271) |
| 338.1 | SHYWS (SEQ ID No: 252) | YIYYSGSTNYNPSLKS (SEQ ID No: 256) | DIPAFAFDI (SEQ ID No: 268) |
| 419.1 | SYHWS (SEQ ID No: 253) | YIYYSGSTNYNPSLKS (SEQ ID No: 256) | DIPAFAFDI (SEQ ID No: 268) |
| 277.1 | SYYWS (SEQ ID No: 249) | HIYYSGSTNYNPSLKS (SEQ ID No: 260) | DIPAFAFDI (SEQ ID No: 268) |
| 946.1 | SYYWS (SEQ ID No: 249) | YIHYSGSTNYNPSLKS (SEQ ID No: 261) | DIPAFAFDI (SEQ ID No: 268) |
| 322.1 | SYYWS (SEQ ID No: 249) | YIYHSGSTNYNPSLKS (SEQ ID No: 262) | DIPAFAFDI (SEQ ID No: 268) |
| 346.1 | SYYWS (SEQ ID No: 249) | YIYYSGSTHYNPSLKS (SEQ ID No: 263) | DIPAFAFDI (SEQ ID No: 268) |
| 304.1 | SYYWS (SEQ ID No: 249) | YIYYSGSTNHNPSLKS (SEQ ID No: 264) | DIPAFAFDI (SEQ ID No: 268) |
| 814.1 | SYYWS (SEQ ID No: 249) | YIYYSGSTNYHPSLKS (SEQ ID No: 265) | DIPAFAFDI (SEQ ID No: 268) |
| 210.1 | SYYWS (SEQ ID No: 249) | YIYYSGSTNYNPSLKS (SEQ ID No: 256) | HIPAFAFDI (SEQ ID No: 272) |
| 460.1 | SYYWS (SEQ ID No: 249) | YIYYSGSTNYNPSLKS (SEQ ID No: 256) | DIPAFAFHI (SEQ ID No: 273) |
| 50 | SYGMH (SEQ ID No: 247) | DIWYDGSNKHYADSVKG (SEQ ID No: 254) | ESDYDRPYFYYGMDV (SEQ ID No: 274) |
| 63 | SYGMH (SEQ ID No: 247) | DIWYDGSNKHYADSVKG (SEQ ID No: 254) | ERDYERPYFYYGMDV (SEQ ID No: 275) |
| 64 | SYGMH (SEQ ID No: 247) | DIWYDGSNKHYADSVKG (SEQ ID No: 254) | ESDCERPYFYYGMDV (SEQ ID No: 276) |

TABLE 1-continued

VH CDRs as defined by Kabat numbering system.

| Antibody No. | VH CDR1 | VH CDR2 | VH CDR3 |
|---|---|---|---|
| 65 | SYGMH (SEQ ID No: 247) | DIWYDGSNKHYADSVKG (SEQ ID No: 254) | ESDDERPYFYYGMDV (SEQ ID No: 277) |
| 65DA | SYGMH (SEQ ID No: 247) | DIWYDGSNKHYADSVKG (SEQ ID No: 254) | ESDDERPYFYYGMDV (SEQ ID No: 277) |
| 66 | SYGMH (SEQ ID No: 247) | DIWYDGSNKHYADSVKG (SEQ ID No: 254) | ESDYERPYFDYGMDV (SEQ ID No: 278) |
| 67 | SYGMH (SEQ ID No: 247) | DIWYDGSNKHYADSVKG (SEQ ID No: 254) | ESDYERPYFYYGIDV (SEQ ID No: 279) |
| 68 | SYGMH (SEQ ID No: 247) | DIWYDGSNKHYADSVKG (SEQ ID No: 254) | ESDYESPYFYYGMDV (SEQ ID No: 280) |
| 83 | SYYWS (SEQ ID No: 249) | YIYYSGSTNYNPSLKS (SEQ ID No: 256) | DIPAFAFEI (SEQ ID No: 281) |
| 85 | SYYWS (SEQ ID No: 249) | YIYYSGSTNYNPSLKS (SEQ ID No: 256) | DIPAFALDI (SEQ ID No: 282) |
| 87 | SYYWS (SEQ ID No: 249) | YIYYSGSTNYNPSLKS (SEQ ID No: 256) | DIPASAFDI (SEQ ID No: 283) |
| 91 | SYYWS (SEQ ID No: 249) | YIYYSGSTNYNPSLKS (SEQ ID No: 256) | DIPAFAFDI (SEQ ID No: 268) |
| 430.1 | SSGYYWG (SEQ ID No: 248) | SLYSSGYTYYNPSLKS (SEQ ID No: 255) | HPVAMNFDD (SEQ ID No: 267) |
| 421.1 | SSGYYWG (SEQ ID No: 248) | SLYSSGYTYYNPSLKS (SEQ ID No: 255) | HPVAMNFDD (SEQ ID No: 267) |
| 139.1 | SSGYYWG (SEQ ID No: 248) | SLYSSGYTYYNPSLKS (SEQ ID No: 255) | HPVAMNFDD (SEQ ID No: 267) |
| 178.1, 391.1, 347.1, 427.1, 178.2, 178.4 | SSGYYWG (SEQ ID No: 248) | SLYSSGYTYYNPSLKS (SEQ ID No: 255) | HPVAMNFDD (SEQ ID No: 267) |

TABLE 2

VH CDRs as defined by IMGT numbering system.

| Antibody No. | VH CDR1 | VH CDR2 | VH CDR3 |
|---|---|---|---|
| 269.1, 141.1, 184.1, 308.1 | GFTFSSYGMH (SEQ ID No: 284) | IWYDGSN (SEQ ID No: 292) | ARESDYERPYFYYGMDV (SEQ ID No: 299) |
| 321.1, 405.1, 472.1 | GGSISSSGYYWG (SEQ ID No: 285) | LYSSGY (SEQ ID No: 293) | ARHPVAMNFDD (SEQ ID No: 300) |
| 245.1, 475.1, 149.1, 133.1, 245.2, 245.4 | GGSISSYYWS (SEQ ID No: 286) | IYYSGS (SEQ ID No: 294) | ARDIPAFAFDI (SEQ ID No: 301) |
| 465.1, 341.1, 228.1, 444.1, 395.1, 465.4 | GFTFSSYAMN (SEQ ID No: 287) | ISGSGGI (SEQ ID No: 295) | ARDWELGRFDY (SEQ ID No: 302) |
| 457.1, 266.1, 329.1, 426.1 | GFTFSSYAMS (SEQ ID No: 288) | ISGSGGI (SEQ ID No: 295) | AKDWEFFWYFDL (SEQ ID No: 303) |
| 173.1, 267.1, 102.1, 420.1, 289.1, 374.1, 394.1, 213.1, 219.1, 380.1, 173.4, 380.4, 420.4, 371.4, 289.4 | GGSISSSGYYWG (SEQ ID No: 285) | IFYSGN (SEQ ID No: 296) | ARRDILTGPFDY (SEQ ID No: 304) |
| 244.1, 244.2, 244.4 | GFTFSSYGMH (SEQ ID No: 284) | IWYDGSN (SEQ ID No: 292) | ARESDYERPYFYYGMDV (SEQ ID No: 299) |
| 5DA | GGSISSSGYYWG (SEQ ID No: 285) | LYSSGY (SEQ ID No: 293) | ARHPVAMNFDD (SEQ ID No: 300) |

TABLE 2-continued

VH CDRs as defined by IMGT numbering system.

| Antibody No. | VH CDR1 | VH CDR2 | VH CDR3 |
|---|---|---|---|
| 474.1, 373.1, 467.1, 908.1, 386.1, 268.1, 342.1, 259.1, 474.2, 542.2, 474.4, 150.1, 246.4 | GGSISSYYWS (SEQ ID No: 286) | IYYSGS (SEQ ID No: 294) | ARDIPAFAFDI (SEQ ID No: 301) |
| 564.2, 564.4 | GFTFSSYAMN (SEQ ID No: 287) | ISGSGGI (SEQ ID No: 295) | ARDWELGRFDY (SEQ ID No: 302) |
| 195.1, 195.2, 195.4 | GFTFSSYAMS (SEQ ID No: 288) | ISGSGGI (SEQ ID No: 295) | AKDWEFFWYFDL (SEQ ID No: 303) |
| 410.1, 410.2, 410.4 | GGSISSSGYYWG (SEQ ID No: 285) | IFYSGN (SEQ ID No: 296) | ARRDILTGPFDY (SEQ ID No: 304) |
| 338.1 | GGSISSHYWS (SEQ ID No: 289) | IYYSGS (SEQ ID No: 294) | ARDIPAFAFDI (SEQ ID No: 301) |
| 419.1 | GGSISSYHWS (SEQ ID No: 290) | IYYSGS (SEQ ID No: 294) | ARDIPAFAFDI (SEQ ID No: 301) |
| 277.1 | GGSISSYYWS (SEQ ID No: 286) | IYYSGS (SEQ ID No: 294) | ARDIPAFAFDI (SEQ ID No: 301) |
| 946.1 | GGSISSYYWS (SEQ ID No: 286) | IHYSGS (SEQ ID No: 297) | ARDIPAFAFDI (SEQ ID No: 301) |
| 322.1 | GGSISSYYWS (SEQ ID No: 286) | IYHSGS (SEQ ID No: 298) | ARDIPAFAFDI (SEQ ID No: 301) |
| 346.1 | GGSISSYYWS (SEQ ID No: 286) | IYYSGS (SEQ ID No: 294) | ARDIPAFAFDI (SEQ ID No: 301) |
| 304.1 | GGSISSYYWS (SEQ ID No: 286) | IYYSGS (SEQ ID No: 294) | ARDIPAFAFDI (SEQ ID No: 301) |
| 814.1 | GGSISSYYWS (SEQ ID No: 286) | IYYSGS (SEQ ID No: 294) | ARDIPAFAFDI (SEQ ID No: 301) |
| 210.1 | GGSISSYYWS (SEQ ID No: 286) | IYYSGS (SEQ ID No: 294) | ARHIPAFAFDI (SEQ ID No: 305) |
| 460.1 | GGSISSYYWS (SEQ ID No: 286) | IYYSGS (SEQ ID No: 294) | ARDIPAFAFHI (SEQ ID No: 306) |
| 50 | GFTFSSYGMH (SEQ ID No: 284) | IWYDGSN (SEQ ID No: 292) | ARESDYDRPYFYYGMDV (SEQ ID No: 307) |
| 63 | GFTFSSYGMH (SEQ ID No: 284) | IWYDGSN (SEQ ID No: 292) | ARERDYERPYFYYGMDV (SEQ ID No: 308) |
| 64 | GFTFSSYGMH (SEQ ID No: 284) | IWYDGSN (SEQ ID No: 292) | ARESDCERPYFYYGMDV (SEQ ID No: 309) |
| 65 | GFTFSSYGMH (SEQ ID No: 284) | IWYDGSN (SEQ ID No: 292) | ARESDDERPYFYYGMDV (SEQ ID No: 310) |
| 65DA | GFTFSSYGMH (SEQ ID No: 284) | IWYDGSN (SEQ ID No: 292) | ARESDDERPYFYYGMDV (SEQ ID No: 310) |
| 66 | GFTFSSYGMH (SEQ ID No: 284) | IWYDGSN (SEQ ID No: 292) | ARESDYERPYFDYGMDV (SEQ ID No: 311) |
| 67 | GFTFSSYGMH (SEQ ID No: 284) | IWYDGSN (SEQ ID No: 292) | ARESDYERPYFYYGIDV (SEQ ID No: 312) |
| 68 | GFTFSSYGMH (SEQ ID No: 284) | IWYDGSN (SEQ ID No: 292) | ARESDYESPYFYYGMDV (SEQ ID No: 313) |
| 83 | GGSVSSYYWS (SEQ ID No: 291) | IYYSGS (SEQ ID No: 294) | ARDIPAFAFEI (SEQ ID No: 314) |
| 85 | GGSISSYYWS (SEQ ID No: 286) | IYYSGS (SEQ ID No: 294) | ARDIPAFALDI (SEQ ID No: 315) |
| 87 | GGSISSYYWS (SEQ ID No: 286) | IYYSGS (SEQ ID No: 294) | ARDIPASAFDI (SEQ ID No: 316) |

TABLE 2-continued

| VH CDRs as defined by IMGT numbering system. | | | |
|---|---|---|---|
| Antibody No. | VH CDR1 | VH CDR2 | VH CDR3 |
| 91 | GGSISSYYWS (SEQ ID No: 286) | IYYSGS (SEQ ID No: 294) | ASDIPAFAFDI (SEQ ID No: 317) |
| 430.1 | GGSISSSGYYWG (SEQ ID No: 285) | LYSSGY (SEQ ID No: 293) | ARHPVAMNFDD (SEQ ID No: 300) |
| 421.1 | GGSISSSGYYWG (SEQ ID No: 285) | LYSSGY (SEQ ID No: 293) | ARHPVAMNFDD (SEQ ID No: 300) |
| 139.1 | GGSISSSGYYWG (SEQ ID No: 285) | LYSSGY (SEQ ID No: 293) | ARHPVAMNFDD (SEQ ID No: 300) |
| 178.1, 391.1, 347.1, 427.1, 178.2, 178.4 | GGSISSSGYYWG (SEQ ID No: 285) | LYSSGY (SEQ ID No: 293) | ARHPVAMNFDD (SEQ ID No: 300) |

TABLE 3

| VH CDRs as defined by Paratome numbering system. | | | |
|---|---|---|---|
| Antibody No. | VH CDR1 | VH CDR2 | VH CDR3 |
| 269.1, 141.1, 184.1, 308.1 | FTFSSYGMH (SEQ ID No: 318) | WVADIWYDGSNKHY (SEQ ID No: 326) | RESDYERPYFYYGMDV (SEQ ID No: 340) |
| 321.1, 405.1, 472.1 | GSISSSGYYWG (SEQ ID No: 319) | WIGSLYSSGYTYY (SEQ ID No: 327) | RHPVAMNFDD (SEQ ID No: 341) |
| 245.1, 475.1, 149.1, 133.1, 245.2, 245.4 | GSISSYYWS (SEQ ID No: 320) | WIGYIYYSGSTNY (SEQ ID No: 328) | RDIPAFAFDI (SEQ ID No: 342) |
| 465.1, 341.1, 228.1, 444.1, 395.1, 465.4 | FTFSSYAMN (SEQ ID No: 321) | WVSAISGSGGITYYA (SEQ ID No: 329) | ARDWELGRFDY (SEQ ID No: 343) |
| 457.1, 266.1, 329.1, 426.1 | FTFSSYAMS (SEQ ID No: 322) | WVSVISGSGGITYYS (SEQ ID No: 330) | AKDWEFFWYFDL (SEQ ID No: 344) |
| 173.1, 267.1, 102.1, 420.1, 289.1, 374.1, 394.1, 213.1, 219.1, 380.1, 173.4, 380.4, 420.4, 371.4, 289.4 | GSISSSGYYWG (SEQ ID No: 319) | WIGSIFYSGNTHY (SEQ ID No: 331) | RRDILTGPFDY (SEQ ID No: 345) |
| 244.1, 244.2, 244.4 | FTFSSYGMH (SEQ ID No: 318) | WVADIWYDGSNKHY (SEQ ID No: 326) | RESDYERPYFYYGMDV (SEQ ID No: 340) |
| 5DA | GSISSSGYYWG (SEQ ID No: 319) | WIGSLYSSGYTYY (SEQ ID No: 327) | RHPVAMNFDD (SEQ ID No: 341) |
| 474.1, 373.1, 467.1, 908.1, 386.1, 268.1, 342.1, 259.1, 474.2, 542.2, 474.4, 150.1, 246.4 | GSISSYYWS (SEQ ID No: 320) | WIGYIYYSGSTNY (SEQ ID No: 328) | RDIPAFAFDI (SEQ ID No: 342) |
| 564.2, 564.4 | FTFSSYAMN (SEQ ID No: 321) | WVSAISGSGGITYY (SEQ ID No: 332) | RDWELGRFDY (SEQ ID No: 346) |
| 195.1, 195.2, 195.4 | FTFSSYAMS (SEQ ID No: 322) | WVSVISGSGGITYYS (SEQ ID No: 333) | AKDWEFFWYFDL (SEQ ID No: 344) |
| 410.1, 410.2, 410.4 | GSISSSGYYWG (SEQ ID No: 319) | WIGSIFYSGNTHY (SEQ ID No: 331) | RRDILTGPFDY (SEQ ID No: 345) |
| 338.1 | GSISSHYWS (SEQ ID No: 323) | WIGYIYYSGSTNY (SEQ ID No: 328) | RDIPAFAFDI (SEQ ID No: 342) |
| 419.1 | GSISSYHWS (SEQ ID No: 324) | WIGYIYYSGSTNY (SEQ ID No: 328) | RDIPAFAFDI (SEQ ID No: 342) |
| 277.1 | GSISSYYWS (SEQ ID No: 320) | WIGHIYYSGSTNY (SEQ ID No: 334) | RDIPAFAFDI (SEQ ID No: 342) |

TABLE 3-continued

| VH CDRs as defined by Paratome numbering system. | | | |
|---|---|---|---|
| Antibody No. | VH CDR1 | VH CDR2 | VH CDR3 |
| 946.1 | GSISSYYWS (SEQ ID No: 320) | WIGYIHYSGSTNY (SEQ ID No: 335) | RDIPAFAFDI (SEQ ID No: 342) |
| 322.1 | GSISSYYWS (SEQ ID No: 320) | WIGYIYHSGSTNY (SEQ ID No: 336) | RDIPAFAFDI (SEQ ID No: 342) |
| 346.1 | GSISSYYWS (SEQ ID No: 320) | WIGYIYYSGSTHY (SEQ ID No: 337) | RDIPAFAFDI (SEQ ID No: 342) |
| 304.1 | GSISSYYWS (SEQ ID No: 320) | WIGYIYYSGSTNH (SEQ ID No: 338) | RDIPAFAFDI (SEQ ID No: 342) |
| 814.1 | GSISSYYWS (SEQ ID No: 320) | WIGYIYYSGSTNY (SEQ ID No: 328) | RDIPAFAFDI (SEQ ID No: 342) |
| 210.1 | GSISSYYWS (SEQ ID No: 320) | WIGYIYYSGSTNY (SEQ ID No: 328) | RHIPAFAFDI (SEQ ID No: 347) |
| 460.1 | GSISSYYWS (SEQ ID No: 320) | WIGYIYYSGSTNY (SEQ ID No: 328) | RDIPAFAFHI (SEQ ID No: 348) |
| 50 | FTFSSYGMH (SEQ ID No: 318) | WVADIWYDGSNKHY (SEQ ID No: 326) | RESDYDRPYFYYGMDV (SEQ ID No: 349) |
| 63 | FTFSSYGMH (SEQ ID No: 318) | WVADIWYDGSNKHY (SEQ ID No: 326) | RERDYERPYFYYGMDV (SEQ ID No: 350) |
| 64 | FTFSSYGMH (SEQ ID No: 318) | WVADIWYDGSNKHY (SEQ ID No: 326) | RESDCERPYFYYGMDV (SEQ ID No: 351) |
| 65 | FTFSSYGMH (SEQ ID No: 318) | WVADIWYDGSNKHY (SEQ ID No: 326) | RESDDERPYFYYGMDV (SEQ ID No: 352) |
| 65DA | FTFSSYGMH (SEQ ID No: 318) | WVADIWYDGSNKHY (SEQ ID No: 326) | RESDDERPYFYYGMDV (SEQ ID No: 352) |
| 66 | FTFSSYGMH (SEQ ID No: 318) | WVEDIWYDGSNKHY (SEQ ID No: 339) | RESDYERPYFDYGMDV (SEQ ID No: 353) |
| 67 | FTFSSYGMH (SEQ ID No: 318) | WVADIWYDGSNKHY (SEQ ID No: 326) | RESDYERPYFYYGIDV (SEQ ID No: 354) |
| 68 | FTFSSYGMH (SEQ ID No: 318) | WVADIWYDGSNKHY (SEQ ID No: 326) | RESDYESPYFYYGMDV (SEQ ID No: 355) |
| 83 | GSVSSYYWS (SEQ ID No: 325) | WIGYIYYSGSTNY (SEQ ID No: 328) | RDIPAFAFEI (SEQ ID No: 356) |
| 85 | GSISSYYWS (SEQ ID No: 320) | WIGYIYYSGSTNY (SEQ ID No: 328) | RDIPAFALDI (SEQ ID No: 357) |
| 87 | GSISSYYWS (SEQ ID No: 320) | WIGYIYYSGSTNY (SEQ ID No: 328) | RDIPASAFDI (SEQ ID No: 358) |
| 91 | GSISSYYWS (SEQ ID No: 320) | WIGYIYYSGSTNY (SEQ ID No: 328) | SDIPAFAFDI (SEQ ID No: 359) |
| 430.1 | GSISSSGYYWG (SEQ ID No: 319) | WIGSLYSSGYTYY (SEQ ID No: 327) | RHPVAMNFDD (SEQ ID No: 341) |
| 421.1 | GSISSSGYYWG (SEQ ID No: 319) | WIGSLYSSGYTYY (SEQ ID No: 327) | RHPVAMNFDD (SEQ ID No: 341) |
| 139.1 | GSISSSGYYWG (SEQ ID No: 319) | WIGSLYSSGYTYY (SEQ ID No: 327) | RHPVAMNFDD (SEQ ID No: 341) |
| 178.1, 391.1, 347.1, 427.1, 178.2, 178.4 | GSISSSGYYWG (SEQ ID No: 319) | WIGSLYSSGYTYY (SEQ ID No: 327) | RHPVAMNFDD (SEQ ID No: 341) |

TABLE 4

VL CDRs as defined by Kabat numbering system.

| Antibody No. | VL CDR1 | VL CDR2 | VL CDR3 |
|---|---|---|---|
| 269.1, 141.1, 184.1, 308.1, 244.1, 244.2, 244.4, 833.1, 982.1, 982.2, 982.4 | RASQSIGSSLH (SEQ ID NO: 111) | YASQSIS (SEQ ID NO: 123) | HQSSSLPQT (SEQ ID NO: 132) |
| 321.1, 405.1, 472.1, 430.1, 421.1, 139.1, 178.1, 391.1, 347.1, 427.1, 178.2, 178.4 | RASQGISSWLA (SEQ ID NO: 112) | AASSLQS (SEQ ID NO: 124) | QQYNSYPYT (SEQ ID NO: 133) |
| 245.1, 475.1, 149.1, 133.1, 474.1, 338.1, 419.1, 277.1, 946.1, 322.1, 346.1, 304.1, 814.1, 210.1, 460.1, 245.2, 245.4, 474.2, 474.4, 542.2, 150.1, 246.4 | RASQSVSYYLA (SEQ ID NO: 113) | DAFNRAT (SEQ ID NO: 125) | QQRINWPLT (SEQ ID NO: 134) |
| 465.1, 341.1, 228.1, 444.1, 395.1, 465.1, 564.2, 564.4 | QASQDISNYLN (SEQ ID NO: 114) | DASNLET (SEQ ID NO: 126) | QQHDHLPWT (SEQ ID NO: 135) |
| 457.1, 266.1, 329.1, 426.1, 195.1, 195.2, 195.4 | GASQSVSSNYLA (SEQ ID NO: 115) | GASSRAT (SEQ ID NO: 127) | QQYGYSYT (SEQ ID NO: 136) |
| 173.1, 267.1, 102.1, 420.1, 289.1, 410.1, 380.1, 410.2, 173.4, 380.4, 420.4, 371.4, 289.4, 410.4 | QASQDITNYLT (SEQ ID NO: 116) | DASNLET (SEQ ID NO: 126) | QQYDNLPT (SEQ ID NO: 137) |
| 49 | RASQSIGSSLH (SEQ ID NO: 111) | YASQSIS (SEQ ID NO: 123) | HQRSSLPQT (SEQ ID NO: 138) |
| 54 | RASQSIGSSLH (SEQ ID NO: 111) | YASQSIS (SEQ ID NO: 123) | HQSSCLPQT (SEQ ID NO: 139) |
| 55 | RASQSIGSSLH (SEQ ID NO: 111) | YASQSIS (SEQ ID NO: 123) | HQSSSFPQT (SEQ ID NO: 140) |
| 56 | RASQSIGSSLH (SEQ ID NO: 111) | YASQSFS (SEQ ID NO: 575) | HQSSSLPHT (SEQ ID NO: 141) |
| 57 | RASQSIGTSLH (SEQ ID NO: 117) | YASQSFS (SEQ ID NO: 575) | HQSSSLPLT (SEQ ID NO: 142) |
| 58 | RASQSIGSSLQ (SEQ ID NO: 118) | YASQSFS (SEQ ID NO: 575) | HQSSSLPPT (SEQ ID NO: 143) |
| 59 | RASQSIGSSLH (SEQ ID NO: 111) | YASQSIS (SEQ ID NO: 123) | HQSSSLPQK (SEQ ID NO: 144) |
| 60 | RASQSIGSSLH (SEQ ID NO: 111) | YASQSIS (SEQ ID NO: 123) | HQSSSLPQP (SEQ ID NO: 145) |
| 80 | RASQSVSYYLA (SEQ ID NO: 113) | DAFNRAT (SEQ ID NO: 125) | QQRINWPLP (SEQ ID NO: 146) |
| 92 | RASQSVNYYLA (SEQ ID NO: 119) | DAFNRAT (SEQ ID NO: 125) | QQRISWPLT (SEQ ID NO: 147) |
| 373.1 | RASQSVSHYLA (SEQ ID NO: 120) | DAFNRAT (SEQ ID NO: 125) | QQRINWPLT (SEQ ID NO: 134) |
| 467.1 | RASQSVSYHLA (SEQ ID NO: 121) | DAFNRAT (SEQ ID NO: 125) | QQRINWPLT (SEQ ID NO: 134) |
| 908.1 | RASQSVSYYLA (SEQ ID NO: 113) | HAFNRAT (SEQ ID NO: 128) | QQRINWPLT (SEQ ID NO: 134) |
| 386.1 | RASQSVSYYLA (SEQ ID NO: 113) | DAFHRAT (SEQ ID NO: 129) | QQRINWPLT (SEQ ID NO: 134) |
| 268.1 | RASQSVSYYLA (SEQ ID NO: 113) | DAFNRAT (SEQ ID NO: 125) | HQRINWPLT (SEQ ID NO: 148) |
| 342.1 | RASQSVSYYLA (SEQ ID NO: 113) | DAFNRAT (SEQ ID NO: 125) | QHRINWPLT (SEQ ID NO: 149) |

TABLE 4-continued

VL CDRs as defined by Kabat numbering system.

| Antibody No. | VL CDR1 | VL CDR2 | VL CDR3 |
|---|---|---|---|
| 259.1 | RASQSVSYYLA (SEQ ID NO: 113) | DAFNRAT (SEQ ID NO: 125) | QQRIHWPLT (SEQ ID NO: 150) |
| 374.1 | QASQHITNYLT (SEQ ID NO: 122) | DASNLET (SEQ ID NO: 126) | QQYDNLPT (SEQ ID NO: 137) |
| 394.1 | QASQDITNYLT (SEQ ID NO: 116) | HASNLET (SEQ ID NO: 130) | QQYDNLPT (SEQ ID NO: 137) |
| 213.1 | QASQDITNYLT (SEQ ID NO: 116) | DASNLET (SEQ ID NO: 126) | QQYHNLPT (SEQ ID NO: 151) |
| 219.1 | QASQDITNYLT (SEQ ID NO: 116) | DASNLHT (SEQ ID NO: 131) | QQYDNLPT (SEQ ID NO: 137) |

TABLE 5

VL CDRs as defined by IMGT numbering system.

| Antibody No. | VL CDR1 | VL CDR2 | VL CDR3 |
|---|---|---|---|
| 269.1, 141.1, 184.1, 308.1, 244.1, 244.2, 244.4, 833.1, 982.1, 982.2, 982.4 | QSIGSS (SEQ ID NO: 152) | YA (SEQ ID NO: 163) | HQSSSLPQT (SEQ ID NO: 168) |
| 321.1, 405.1, 472.1, 430.1, 421.1, 139.1, 178.1, 391.1, 347.1, 427.1, 178.2, 178.4 | QGISSW (SEQ ID NO: 153) | AA (SEQ ID NO: 164) | QQYNSYPYT (SEQ ID NO: 169) |
| 245.1, 475.1, 149.1, 133.1, 474.1, 338.1, 419.1, 277.1, 946.1, 322.1, 346.1, 304.1, 814.1, 210.1, 460.1, 245.2, 245.4, 474.2, 474.4, 542.2, 150.1, 246.4 | QSVSYY (SEQ ID NO: 154) | DA (SEQ ID NO: 165) | QQRINWPLT (SEQ ID NO: 170) |
| 465.1, 341.1, 228.1, 444.1, 395.1, 465.1, 564.2, 564.4 | QDISNY (SEQ ID NO: 155) | DA (SEQ ID NO: 165) | QQHDHLPWT (SEQ ID NO: 171) |
| 457.1, 266.1, 329.1, 426.1, 195.1, 195.2, 195.4 | QSVSSNY (SEQ ID NO: 156) | GA (SEQ ID NO: 166) | QQYGYSYT (SEQ ID NO: 172) |
| 173.1, 267.1, 102.1, 420.1, 289.1, 410.1, 380.1, 410.2, 173.4, 380.4, 420.4, 371.4, 289.4, 410.4 | QDITNY (SEQ ID NO: 157) | DA (SEQ ID NO: 165) | QQYDNLPT (SEQ ID NO: 173) |
| 49 | QSIGSS (SEQ ID NO: 152) | YA (SEQ ID NO: 163) | HQRSSLPQT (SEQ ID NO: 174) |
| 54 | QSIGSS (SEQ ID NO: 152) | YA (SEQ ID NO: 163) | HQSSCLPQT (SEQ ID NO: 175) |
| 55 | QSIGSS (SEQ ID NO: 152) | YA (SEQ ID NO: 163) | HQSSSFPQT (SEQ ID NO: 176) |
| 56 | QSIGSS (SEQ ID NO: 152) | YA (SEQ ID NO: 163) | HQSSSLPHT (SEQ ID NO: 177) |
| 57 | QSIGTS (SEQ ID NO: 158) | YA (SEQ ID NO: 163) | HQSSSLPLT (SEQ ID NO: 178) |
| 58 | QSIGSS (SEQ ID NO: 152) | YA (SEQ ID NO: 163) | HQSSSLPPT (SEQ ID NO: 179) |
| 59 | QSIGSS (SEQ ID NO: 152) | YA (SEQ ID NO: 163) | HQSSSLPQK (SEQ ID NO: 180) |
| 60 | QSIGSS (SEQ ID NO: 152) | YA (SEQ ID NO: 163) | HQSSSLPQP (SEQ ID NO: 181) |

TABLE 5-continued

| VL CDRs as defined by IMGT numbering system. | | | |
|---|---|---|---|
| Antibody No. | VL CDR1 | VL CDR2 | VL CDR3 |
| 80 | QSVSYY (SEQ ID NO: 154) | DA (SEQ ID NO: 165) | QQRINWPLP (SEQ ID NO: 182) |
| 92 | QSVNYY (SEQ ID NO: 159) | DA (SEQ ID NO: 165) | QQRISWPLT (SEQ ID NO: 183) |
| 373.1 | QSVSHY (SEQ ID NO: 160) | DA (SEQ ID NO: 165) | QQRINWPLT (SEQ ID NO: 170) |
| 467.1 | QSVSYH (SEQ ID NO: 161) | DA (SEQ ID NO: 165) | QQRINWPLT (SEQ ID NO: 170) |
| 908.1 | QSVSYY (SEQ ID NO: 154) | HA (SEQ ID NO: 167) | QQRINWPLT (SEQ ID NO: 170) |
| 386.1 | QSVSYY (SEQ ID NO: 154) | DA (SEQ ID NO: 165) | QQRINWPLT (SEQ ID NO: 170) |
| 268.1 | QSVSYY (SEQ ID NO: 154) | DA (SEQ ID NO: 165) | HQRINWPLT (SEQ ID NO: 184) |
| 342.1 | QSVSYY (SEQ ID NO: 154) | DA (SEQ ID NO: 165) | QHRINWPLT (SEQ ID NO: 185) |
| 259.1 | QSVSYY (SEQ ID NO: 154) | DA (SEQ ID NO: 165) | QQRIHWPLT (SEQ ID NO: 186) |
| 374.1 | QHITNY (SEQ ID NO: 162) | DA (SEQ ID NO: 165) | QQYDNLPT (SEQ ID NO: 173) |
| 394.1 | QDITNY (SEQ ID NO: 157) | HA (SEQ ID NO: 167) | QQYDNLPT (SEQ ID NO: 173) |
| 213.1 | QDITNY (SEQ ID NO: 157) | DA (SEQ ID NO: 165) | QQYHNLPT (SEQ ID NO: 187) |
| 219.1 | QDITNY (SEQ ID NO: 157) | DA (SEQ ID NO: 165) | QQYDNLPT (SEQ ID NO: 173) |

TABLE 6

| VL CDRs as defined by Paratome numbering system. | | | |
|---|---|---|---|
| Antibody No. | VL CDR1 | VL CDR2 | VL CDR3 |
| 269.1, 141.1, 184.1, 308.1, 244.1, 244.2, 244.4, 833.1, 982.1, 982.2, 982.4 | QSIGSSLH (SEQ ID NO: 188) | LLIKYASQSIS (SEQ ID NO: 197) | HQSSSLPQ (SEQ ID NO: 207) |
| 321.1, 405.1, 472.1, 430.1, 421.1, 139.1, 178.1, 391.1, 347.1, 427.1, 178.2, 178.4 | QGISSWLA (SEQ ID NO: 189) | SLIYAASSLQS (SEQ ID NO: 198) | QQYNSYPY (SEQ ID NO: 208) |
| 245.1, 475.1, 149.1, 133.1, 474.1, 338.1, 419.1, 277.1, 946.1, 322.1, 346.1, 304.1, 814.1, 210.1, 460.1, 245.2, 245.4, 474.2, 474.4, 542.2, 150.1, 246.4 | QSVSYYLA (SEQ ID NO: 190) | LLIYDAFNRAT (SEQ ID NO: 199) | QQRINWPL (SEQ ID NO: 209) |
| 465.1, 341.1, 228.1, 444.1, 395.1, 465.1, 564.2, 564.4 | QDISNYLN (SEQ ID NO: 191) | LLIYDASNLET (SEQ ID NO: 200) | QQHDHLPW (SEQ ID NO: 210) |
| 457.1, 266.1, 329.1, 426.1, 195.1, 195.2, 195.4 | QSVSSNYLA (SEQ ID NO: 192) | LLIYGASSRAT (SEQ ID NO: 201) | QQYGYSY (SEQ ID NO: 211) |
| 173.1, 267.1, 102.1, 420.1, 289.1, 410.1, 380.1, 410.2, 173.4, 380.4, 420.4, 371.4, 289.4, 410.4 | QDITNYLT (SEQ ID NO: 193) | LLIYDASNLET (SEQ ID NO: 200) | QQYDNLP (SEQ ID NO: 212) |
| 49 | QSIGSSLH (SEQ ID NO: 188) | LLIKYASQSIS (SEQ ID NO: 197) | HQRSSLPQ (SEQ ID NO: 213) |

TABLE 6-continued

VL CDRs as defined by Paratome numbering system.

| Antibody No. | VL CDR1 | VL CDR2 | VL CDR3 |
|---|---|---|---|
| 54 | QSIGSSLH (SEQ ID NO: 188) | LLIKYASQSIS (SEQ ID NO: 197) | HQSSCLPQ (SEQ ID NO: 214) |
| 55 | QSIGSSLH (SEQ ID NO: 188) | LLIKYASQSIS (SEQ ID NO: 197) | HQSSSFPQ (SEQ ID NO: 215) |
| 56 | QSIGSSLH (SEQ ID NO: 188) | LLIKYASQSFS (SEQ ID NO: 202) | HQSSSLPH (SEQ ID NO: 216) |
| 57 | QSIGTSLH (SEQ ID NO: 194) | LLIKYASQSFS (SEQ ID NO: 202) | HQSSSLPL (SEQ ID NO: 217) |
| 58 | QSIGSSLQ (SEQ ID NO: 195) | LLIKYASQSFS (SEQ ID NO: 202) | HQSSSLPP (SEQ ID NO: 218) |
| 59 | QSIGSSLH (SEQ ID NO: 188) | LLIKYASQSIS (SEQ ID NO: 197) | HQSSSLPQK (SEQ ID NO: 219) |
| 60 | QSIGSSLH (SEQ ID NO: 188) | LLIKYASQSIS (SEQ ID NO: 197) | HQSSSLPQP (SEQ ID NO: 220) |
| 80 | QSVSYYLA (SEQ ID NO: 190) | LLIYDAFNRAT (SEQ ID NO: 199) | QQRINWPLP (SEQ ID NO: 221) |
| 92 | QSVNYYLA (SEQ ID NO: 576) | LLIYDAFNRAT (SEQ ID NO: 199) | QQRISWPL (SEQ ID NO: 222) |
| 373.1 | QSVSHYLA (SEQ ID NO: 577) | LLIYDAFNRAT (SEQ ID NO: 199) | QQRINWPL (SEQ ID NO: 209) |
| 467.1 | QSVSYHLA (SEQ ID NO: 578) | LLIYDAFNRAT (SEQ ID NO: 199) | QQRINWPL (SEQ ID NO: 209) |
| 908.1 | QSVSYYLA (SEQ ID NO: 190) | LLIYHAFNRAT (SEQ ID NO: 203) | QQRINWPL (SEQ ID NO: 209) |
| 386.1 | QSVSYYLA (SEQ ID NO: 190) | LLIYDAFHRAT (SEQ ID NO: 204) | QQRINWPL (SEQ ID NO: 209) |
| 268.1 | QSVSYYLA (SEQ ID NO: 190) | LLIYDAFNRAT (SEQ ID NO: 199) | HQRINWPL (SEQ ID NO: 223) |
| 342.1 | QSVSYYLA (SEQ ID NO: 190) | LLIYDAFNRAT (SEQ ID NO: 199) | QHRINWPL (SEQ ID NO: 224) |
| 259.1 | QSVSYYLA (SEQ ID NO: 190) | LLIYDAFNRAT (SEQ ID NO: 199) | QQRIHWPL (SEQ ID NO: 225) |
| 374.1 | QHITNYLT (SEQ ID NO: 196) | LLIYDASNLET (SEQ ID NO: 200) | QQYDNLP (SEQ ID NO: 212) |
| 394.1 | QDITNYLT (SEQ ID NO: 193) | LLIYHASNLET (SEQ ID NO: 205) | QQYDNLP (SEQ ID NO: 212) |
| 213.1 | QDITNYLT (SEQ ID NO: 193) | LLIYDASNLET (SEQ ID NO: 200) | QQYHNLP (SEQ ID NO: 226) |
| 219.1 | QDITNYLT (SEQ ID NO: 193) | LLIYDASNLHT (SEQ ID NO: 206) | QQYDNLP (SEQ ID NO: 212) |

Also provided herein is an antibody or antigen-binding fragment that specifically binds to VISTA comprising a VH and a VL, wherein the VH comprises a VH CDR1, a VH CDR2 and a VH CDR3 of any one of the SEQ ID NOs: set forth in Table 7 as the VH of an antibody. In specific embodiments, the VH CDRs are defined by the Kabat numbering system. In specific embodiments, the VH CDRs are defined by the Chothia numbering system. In specific embodiments, the VH CDRs are defined by the AbM numbering system. In specific embodiments, the VH CDRs are defined by the IMGT numbering system. In specific embodiments, the VH CDRs are defined by the Paratome numbering system. In specific embodiments, the VH CDRs are defined by the Contact numbering system.

In particular embodiments, an antibody or antigen-binding fragment that specifically binds to VISTA comprising a VH and a VL, wherein the VH comprises a VH CDR1, a VH CDR2 and a VH CDR3 of any one of the SEQ ID NOs: set forth in Table 7 as the VH of an antibody, and the VL comprises a VL CDR1, a VL CDR2 and a VL CDR3 of the SEQ ID NO: set forth in Table 8 as the VL for said antibody. In specific embodiments, the VH CDRs are defined by the Kabat numbering system. In specific embodiments, the VH CDRs are defined by the Chothia numbering system. In specific embodiments, the VH CDRs are defined by the AbM numbering system. In specific embodiments, the VH CDRs are defined by the IMGT numbering system. In specific embodiments, the VH CDRs are defined by the Paratome numbering system. In specific embodiments, the VH CDRs are defined by the Contact numbering system.

The CDRs of an antibody or antigen-binding fragment provided herein that specifically binds to VISTA may be modified, for example, by introducing one or more mutations in one or more of the CDRs. Such mutations may, for example, change the binding affinity of the antibody or antigen-binding fragment thereof at a certain pH value, and thus affect the biological half-life of the antibody. Thus, redesigning an antibody with decreased binding affinity to VISTA in the endosome after internalization can reduce antibody depletion and increase half-life.

In specific embodiments, an antibody or an antigen-binding fragment thereof that specifically binds to VISTA provided herein binds to VISTA with higher affinity at neutral pH than at acidic pH (i.e., reduced binding affinity at acidic pH). Anti-VISTA antibodies with reduced binding affinity at acidic pH can possess various improved/enhanced biological characteristics as compared to antibodies that do not exhibit reduced binding affinity at acidic pH. For example, in specific embodiments, antibodies or antigen-binding fragments thereof that specifically bind to VISTA provided herein with reduced binding affinity at acidic pH can have longer half-lives in circulation as compared to anti-VISTA antibodies that do not exhibit reduced binding affinity at acidic pH. In specific embodiments, an antibody or an antigen-binding fragment thereof that specifically binds to VISTA provided herein that has reduced binding affinity at acidic pH can be cleared from circulation more slowly than an anti-VISTA antibody that lacks pH-dependent binding. Slower antibody clearance (i.e., longer half-life in circulation) should correlate with prolonged biological activity. Thus, in specific embodiments, an antibody or an antigen-binding fragment thereof that specifically binds to VISTA provided herein can be administered to a subject less frequently and/or at lower doses and will nonetheless exhibit equivalent (or better) efficacy than antibodies that do not have reduced binding affinity at acidic pH.

Without wishing to be bound by theory or mechanism, it is believed that anti-VISTA antibodies with lower binding affinity at acidic pH as compared to neutral pH dissociate from the antigen in the acidic environment of the endosome and are recycled to the plasma where they undergo additional rounds of therapeutic antigen binding. Modifications to neonatal Fc receptor (FcRn) binding in the Fc region of antibodies (e.g., modifications, for example, those described below) together with the introduction of histidine switches in the antigen binding region can result in antibodies that bind with high affinity to VISTA at the cell surface, dissociate from VISTA upon trafficking to the acidic endosomal environment, and are captured and recycled to the extracellular space by the FcRn receptor.

In specific embodiments, an antibody or an antigen-binding fragment thereof that specifically binds to VISTA provided herein comprises one or more histidine substitutions in any Y, D, E, N or Q amino acid occurring in a light chain CDR or heavy chain CDR. In a specific embodiment, the antibody or antigen-binding fragment thereof that specifically binds to VISTA provided herein comprises one histidine substitution in an Y, D, E, N or Q amino acid occurring in a light chain CDR or heavy chain CDR. In particular embodiments, an antibody or an antigen-binding fragment thereof that specifically binds to VISTA provided herein comprises the VH CDRs of Antibody No. 474.1 as set forth in Table 1, Table 2, or Table 3 and the VL CDRs of Antibody No. 474.1 as set forth in Table 4, Table 5, or Table 6 except with one or more histidine substitutions in the VL CDRs, which may be selected from Y31H (e.g., as present in Antibody No. 373.1), Y32H (e.g., as present in Antibody No. 467.1), D50H (e.g., as present in Antibody No. 908.1), N53H (e.g., as present in Antibody No. 386.1), Q89H (e.g., as present in Antibody No. 268.1), Q90H (e.g., as present in Antibody No. 342.1), and N93H (e.g., as present in Antibody No. 259.1), each numbered according to the Kabat numbering system.

In particular embodiments, an antibody or an antigen-binding fragment thereof that specifically binds to VISTA provided herein comprises the VH CDRs of Antibody No. 474.1 as set forth in Table 1, Table 2, or Table 3 and the VL CDRs of Antibody No. 474.1 as set forth in Table 4, Table 5, or Table 6 except with one or more histidine substitutions in the VH CDRs, which may be selected from: Y32H (e.g., as present in Antibody No. 338.1), Y33H (e.g., as present in Antibody No. 419.1), Y50H (e.g., as present in Antibody No. 277.1), Y52H (e.g., as present in Antibody No. 946.1), Y53H (e.g., as present in Antibody No. 322.1), N58H (e.g., as present in Antibody No. 346.1), Y59H (e.g., as present in Antibody No. 304.1), N60H (e.g., as present in Antibody No. 814.1), D95H (e.g., as present in Antibody No. 210.1) and D101H (e.g., as present in Antibody No. 460.1), each according to the Kabat numbering system.

In particular embodiments, an antibody or an antigen-binding fragment thereof that specifically binds to VISTA provided herein comprises the VH CDRs of Antibody No. 173.1 as set forth in Table 1, Table 2, or Table 3 and the VL CDRs of Antibody No. 173.1 as set forth in Table 4, Table 5, or Table 6 except with one or more histidine substitutions in the VL CDRs which may be selected from: D47H (e.g., as present in Antibody No. 374.1), D69H (e.g., as present in Antibody No. 394.1), D111H (e.g., as present in Antibody No. 213.1), and E74H (e.g., as present in Antibody No. 219.1), each according to the Kabat numbering system.

In certain aspects, an antibody described herein may be described by specifying its VH domain alone, or its VL domain alone, or set of three CDRs of the VH or VL. See, for example, Clackson T et al., (1991) Nature 352:624-628, which is incorporated herein by reference in its entirety, describing methods of producing antibodies that bind a specific antigen by using a specific VH domain (or VL domain) and screening a library for the complementary variable domains. See also, Kim S J & Hong H J, (2007) J Microbiol 45:572-577, which is incorporated herein by reference in its entirety, describing methods of producing antibodies that bind a specific antigen by using a specific VH domain and screening a library (e.g., human VL library) for complementary VL domains; the selected VL domains in turn could be used to guide selection of additional complementary (e.g., human) VH domains.

In specific embodiments, an antibody or an antigen-binding fragment thereof that specifically binds to VISTA comprises a VH, wherein the VH comprises the SEQ ID NO: set forth in Table 7 as the VH of said antibody. In specific embodiments, an antibody or an antigen-binding fragment thereof that specifically binds to VISTA comprises a VL, wherein the VL comprises the SEQ ID NO: set forth in Table 8 as the VL of said antibody. In specific embodiments, an antibody or an antigen-binding fragment thereof that specifically binds to VISTA comprises a VH, wherein the VH comprises the SEQ ID NO: set forth in Table 7 as the VH of said antibody, and a VL. In specific embodiments, an antibody or an antigen-binding fragment thereof that specifically binds to VISTA comprises a VH and a VL, wherein (i) the VH comprises the SEQ ID NO: set forth in Table 7 as the VH of said antibody, and (ii) the VL comprises the SEQ ID NO: set forth in Table 8 as the VL of said antibody.

In certain embodiments, an antibody or an antigen-binding fragment thereof that specifically binds to VISTA comprises a VH and a VL, wherein the VH has at least 80%, at least 85%, at least 90%, at least 95%, at least 96%, at least 97%, at least 98%, or at least 99% sequence identity to the amino acid sequence of a VH set forth in Table 7. In certain embodiments, an antibody or an antigen-binding fragment thereof that specifically binds to VISTA comprises a VH and a VL, wherein the VH has at least 95% sequence identity to the amino acid sequence of a VH set forth in Table 7. In certain embodiments, an antibody or an antigen-binding fragment thereof that specifically binds to VISTA comprises a VH and a VL, wherein the VL has at least 80%, at least 85%, at least 90%, at least 95%, at least 96%, at least 97%, at least 98%, or at least 99% sequence identity to the amino acid sequence of a VL set forth in Table 8. In certain embodiments, an antibody or an antigen-binding fragment thereof that specifically binds to VISTA comprises a VL having at least 95% sequence identity to the amino acid sequence of a VL set forth in Table 8.

In certain embodiments, an antibody or an antigen-binding fragment thereof that specifically binds to VISTA comprises a VH and a VL, wherein (i) the VL has at least 80%, at least 85%, at least 90%, at least 95%, at least 96%, at least 97%, at least 98%, or at least 99% sequence identity to the amino acid sequence of the VH of an antibody set forth in Table 7 and (ii) the VL has at least 80%, at least 85%, at least 90%, at least 95%, at least 96%, at least 97%, at least 98%, or at least 99% sequence identity to the amino acid sequence of the VL of said antibody set forth in Table 8. In certain embodiments, an antibody or an antigen-binding fragment thereof that specifically binds to VISTA comprises a VH and a VL, wherein the VH has at least 95%, sequence identity to the amino acid sequence of the VH of an antibody set forth in Table 7 and (ii) the VL has at least 95% sequence identity to the VL of said antibody set forth in Table 8.

TABLE 7

Antibody Variable Heavy Chain Sequences

| Antibody No. | Variable Heavy Chain Sequence (VH) |
|---|---|
| 269.1, 141.1, 184.1, 308.1 | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDYERPYFYYGMDVWGQGTTVTVSSA (SEQ ID NO: 584) |
| 321.1, 405.1, 472.1 | QLQLQESGPGLVKPSETLSLTCTVSGGSISSSGYYWGWIRQPPGKGLE WIGSLYSSGYTYYNPSLKSRVTISVDTSKNQCSLKLNSVTTADTAVYY CARHPVAMNFDDWGQGTLVTVSSA (SEQ ID NO: 585) |
| 245.1, 475.1, 149.1, 133.1, 245.2, 245.4 | QVQLQESGPGLVKPSETLSLTCTVSGGSISSYYWSWIRQPPGKGLEWIG YIYYSGSTNYNPSLKSRVTISVDTSKSQFSLKLSSVTAADTAVYYCARD IPAFAFDIWGQGTMVIVSSA (SEQ ID NO: 586) |
| 465.1, 341.1, 228.1, 444.1, 395.1, 465.4 | EVQLVESGGGLIQPGGSLRFSCAASGFTFSSYAMNWVRQAPGKGLEW VSAISGSGGITYYADSVKGRFTISRDNSKNTLYLQMNSLRAEDTAVYY CARDWELGRFDYWGQGTLVTVSSA (SEQ ID NO: 587) |
| 457.1, 266.1, 329.1, 426.1 | EVQLVESGGGLVQPGGSLRLSCAASGFTFSSYAMSWVRQAPGKGLEW VSVISGSGGITYYSDSVKGRFTISRDNSKNTLYLQMNSLRAEDTAVYY CAKDWEFFWYFDLWGRGTLVTVSSA (SEQ ID NO: 588) |
| 173.1, 267.1, 102.1, 420.1, 289.1, 374.1, 394.1, 213.1, 219.1, 380.1, 173.4, 380.4, 420.4, 371.4, 289.4 | QLQLQESGPGLVKPSETLSLTCIVSGGSISSSGYYWGWIRQPPGKGLEW IGSIFYSGNTHYNPSLKSRVTIPVDTSKNQFSLKLSSVTAADSAVYYCA RRDILTGPFDYWGQGTLVTVSSA (SEQ ID NO: 589) |
| 244.1, 244.2, 244.4 | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDYERPYFYYGMDVWGQGTTVTVSS (SEQ ID NO: 590) |
| 5DA | QLQLQESGPGLVKPSETLSLTCTVSGGSISSSGYYWGWIRQPPGKGLE WIGSLYSSGYTYYNPSLKSRVTISVDTSKNQCSLKLNSVTTADTAVYY CARHPVAMNFDDWGQGTLVTVSS (SEQ ID NO: 591) |
| 474.1, 373.1, 467.1, 908.1, 386.1, 268.1, 342.1, 259.1, 474.2, 542.2, 474.4, 246.4, 150.1 | QVQLQESGPGLVKPSETLSLTCTVSGGSISSYYWSWIRQPPGKGLEWIG YIYYSGSTNYNPSLKSRVTISVDTSKSQFSLKLSSVTAADTAVYYCARD IPAFAFDIWGQGTMVIVSS (SEQ ID NO: 592) |
| 564.2, 564.4 | EVQLVESGGGLIQPGGSLRFSCAASGFTFSSYAMNWVRQAPGKGLEW VSAISGSGGITYYADSVKGRFTISRDNSKNTLYLQMNSLRAEDTAVYY CARDWELGRFDYWGQGTLVTVSS (SEQ ID NO: 593) |
| 195.1, 195.2, 195.4 | EVQLVESGGGLVQPGGSLRLSCAASGFTFSSYAMSWVRQAPGKGLEW VSVISGSGGITYYSDSVKGRFTISRDNSKNTLYLQMNSLRAEDTAVYY CAKDWEFFWYFDLWGRGTLVTVSS (SEQ ID NO: 594) |

TABLE 7-continued

| Antibody Variable Heavy Chain Sequences | |
|---|---|
| Antibody No. | Variable Heavy Chain Sequence (VH) |
| 410.1, 410.2, 410.4 | QLQLQESGPGLVKPSETLSLTCIVSGGSISSSGYYWGWIRQPPGKGLEW IGSIFYSGNTHYNPSLKSRVTIPVDTSKNQFSLKLSSVTAADSAVYYCA RRDILTGPFDYWGQGTLVTVSS (SEQ ID NO: 595) |
| 338.1 | QVQLQESGPGLVKPSETLSLTCTVSGGSISSHYWSWIRQPPGKGLEWIG YIYYSGSTNYNPSLKSRVTISVDTSKSQFSLKLSSVTAADTAVYYCARD IPAFAFDIWGQGTMVIVSS (SEQ ID NO: 596) |
| 419.1 | QVQLQESGPGLVKPSETLSLTCTVSGGSISSYHWSWIRQPPGKGLEWIG YIYYSGSTNYNPSLKSRVTISVDTSKSQFSLKLSSVTAADTAVYYCARD IPAFAFDIWGQGTMVIVSS (SEQ ID NO: 597) |
| 277.1 | QVQLQESGPGLVKPSETLSLTCTVSGGSISSYYWSWIRQPPGKGLEWIG HIYYSGSTNYNPSLKSRVTISVDTSKSQFSLKLSSVTAADTAVYYCARD IPAFAFDIWGQGTMVIVSS (SEQ ID NO: 227) |
| 946.1 | QVQLQESGPGLVKPSETLSLTCTVSGGSISSYYWSWIRQPPGKGLEWIG YIHYSGSTNYNPSLKSRVTISVDTSKSQFSLKLSSVTAADTAVYYCARD IPAFAFDIWGQGTMVIVSS (SEQ ID NO: 228) |
| 322.1 | QVQLQESGPGLVKPSETLSLTCTVSGGSISSYYWSWIRQPPGKGLEWIG YIYHSGSTNYNPSLKSRVTISVDTSKSQFSLKLSSVTAADTAVYYCARD IPAFAFDIWGQGTMVIVSS (SEQ ID NO: 229) |
| 346.1 | QVQLQESGPGLVKPSETLSLTCTVSGGSISSYYWSWIRQPPGKGLEWIG YIYYSGSTHYNPSLKSRVTISVDTSKSQFSLKLSSVTAADTAVYYCARD IPAFAFDIWGQGTMVIVSS (SEQ ID NO: 230) |
| 304.1 | QVQLQESGPGLVKPSETLSLTCTVSGGSISSYYWSWIRQPPGKGLEWIG YIYYSGSTNHNPSLKSRVTISVDTSKSQFSLKLSSVTAADTAVYYCARD IPAFAFDIWGQGTMVIVSS (SEQ ID NO: 231) |
| 814.1 | QVQLQESGPGLVKPSETLSLTCTVSGGSISSYYWSWIRQPPGKGLEWIG YIYYSGSTNYHPSLKSRVTISVDTSKSQFSLKLSSVTAADTAVYYCARD IPAFAFDIWGQGTMVIVSS (SEQ ID NO: 232) |
| 210.1 | QVQLQESGPGLVKPSETLSLTCTVSGGSISSYYWSWIRQPPGKGLEWIG YIYYSGSTNYNPSLKSRVTISVDTSKSQFSLKLSSVTAADTAVYYCARH IPAFAFDIWGQGTMVIVSS (SEQ ID NO: 233) |
| 460.1 | QVQLQESGPGLVKPSETLSLTCTVSGGSISSYYWSWIRQPPGKGLEWIG YIYYSGSTNYNPSLKSRVTISVDTSKSQFSLKLSSVTAADTAVYYCARD IPAFAFHIWGQGTMVIVSS (SEQ ID NO: 234) |
| 50 | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDYDRPYFYYGMDVWGQGTTVTVSSA (SEQ ID NO: 235) |
| 63 | QVQLVESGGGVVQPGRSLRLSCAASGFTFSSYGMHWVRQAPGKGLE WVADIWYDGSNKHYADSVKGRFTISRDNSKNTLYLQMNSLRDEDTA VYYCARERDYERPYFYYGMDVWGQGTTVTVSSA (SEQ ID NO: 236) |
| 64 | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDCERPYFYYGMDVWGQGTTVTVSSA (SEQ ID NO: 237) |
| 65, 833.1 | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDDERPYFYYGMDVWGQGTTVTVSSA (SEQ ID NO: 238) |
| 65DA | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDDERPYFYYGMDVWGQGTTVTVSS (SEQ ID NO: 239) |
| 66 | QVQLVESGGGVVQPGRSLRLSCAASGFTFSSYGMHWVRQAPGQGLE WVEDIWYDGSNKHYADSVKGRFTISRDNSKNTLYLQMNSLRAEDTA VYYCARESDYERPYFDYGMDVWGQGTTVTVSSA (SEQ ID NO: 240) |
| 67 | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDYERPYFYYGIDVWGQGTTVTVSSA (SEQ ID NO: 241) |
| 68 | QVQLVESGGGVVQPGRSLRLSCAASGFTFSSYGMHWVRQAPGKGLE WVADIWYDGSNKHYADSVKGRFTISRDNSKNTLYLQMNSLRAEDTA VYYCARESDYESPYFYYGMDVWGQGTTVTVSSA (SEQ ID NO: 242) |

TABLE 7-continued

| Antibody Variable Heavy Chain Sequences | |
|---|---|
| Antibody No. | Variable Heavy Chain Sequence (VH) |
| 83 | QVQLQESGPGLVKPSETLSLTCTVSGGSVSSYYWSWIRQPPGKGLEWI GYIYYSGSTNYNPSLKSRVTISVDTSKSQFSLKLGSVTAADTAGYYCA RDIPAFAFEIWGQGTMVIVSSA (SEQ ID NO: 243) |
| 85 | QVQLQESGPGLVKPSETLSLTCTVSGGSISSYYWSWIRKPPGKGLEWIG YIYYSGSTNYNPSLKSRVTISVDTSKSQFSLKLSSVTAADTAVYYCARD IPAFALDIWGQGTMVTVSSA (SEQ ID NO: 244) |
| 87 | QVQLQESGPGLVKPSETLSLTCTVSGGSISSYYWSWIRQPPGKGLEWIG YIYYSGSTNYNPSLKSRVTISVDTSKSQFSLKLSSVTAADTAVYYCARD IPASAFDIWGQGTMVIVSSA (SEQ ID NO: 245) |
| 91 | QVQLQESGPGLVKPSETLSLTCTVSGGSISSYYWSWIRQPPGKGLEWIG YIYYSGSTNYNPSLKSRVTISVDTSKSQFSLKLSSVTAADTAVYYCASD IPAFAFDIWGQGTMVIVSSA (SEQ ID NO: 246) |
| 430.1 | QLQLQESGPGLVKPSETLSLTCTVSGGSISSSGYYWGWIRQPPGKGLE WIGSLYSSGYTYYNPSLKSRVTISVDTSKNQFSLKLNSVTTADTAVYY CARHPVAMNFDDWGQGTLVTVSSA (SEQ ID NO: 383) |
| 421.1 | QLQLQESGPGLVKPSETLSLTCTVSGGSISSSGYYWGWIRQPPGKGLE WIGSLYSSGYTYYNPSLKSRVTISVDTSKNQASLKLNSVTTADTAVYY CARHPVAMNFDDWGQGTLVTVSSA (SEQ ID NO: 384) |
| 139.1 | QLQLQESGPGLVKPSETLSLTCTVSGGSISSSGYYWGWIRQPPGKGLE WIGSLYSSGYTYYNPSLKSRVTISVDTSKNQSSLKLNSVTTADTAVYY CARHPVAMNFDDWGQGTLVTVSSA (SEQ ID NO: 385) |
| 178.1, 391.1, 347.1, 427.1, 178.2, 178.4 | QLQLQESGPGLVKPSETLSLTCTVSGGSISSSGYYWGWIRQPPGKGLE WIGSLYSSGYTYYNPSLKSRVTISVDTSKNQASLKLNSVTTADTAVYY CARHPVAMNFDDWGQGTLVTVSSA (SEQ ID NO: 386) |

TABLE 8

| Variable Light Chain Sequences | |
|---|---|
| Antibody No. | Variable Light Chain Sequence (VL) |
| 269.1, 141.1, 184.1, 308.1, 244.1, 244.2, 244.4, 833.1, 982.1, 982.2, 982.4 | EIVLTQSPDFQSVTPKEKVTITCRASQSIGSSLHWYQQKPDQSPK LLIKYASQSISGVPSRFSGSGSGTDFTLTINSLEAEDAAAYYCHQ SSSLPQTFGQGTKVEIK (SEQ ID NO: 84) |
| 321.1, 405.1, 472.1, 430.1, 421.1, 139.1, 178.1, 391.1, 347.1, 427.1, 178.2, 178.4 | DIQMTQSPSSLSASVGDRVTITCRASQGISSWLAWYQQKPEKAP KSLIYAASSLQSGVPSRFSGSGSGTDFTLTISSLQPEDFATYYCQQ YNSYPYTFGQGTKLEIK (SEQ ID NO: 85) |
| 245.1, 475.1, 149.1, 133.1, 474.1, 338.1, 419.1, 277.1, 946.1, 322.1, 346.1, 304.1, 814.1, 210.1, 460.1, 245.2, 245.4, 474.2, 474.4, 542.2, 150.1, 246.4 | EIVLTQSPATLSLSPGERATLSCRASQSVSYYLAWYQQKPGQAP RLLIYDAFNRATGIPARFSGSGSGTDFTLTISSLEPEDFAVYYCQQ RINWPLTFGGGTKVEIK (SEQ ID NO: 86) |
| 465.1, 341.1, 228.1, 444.1, 395.1, 465.1, 564.2, 564.4 | DIQMTQSPSSLSASVGDRVTITCQASQDISNYLNWYQQKPGRAP ELLIYDASNLETGVPSRFSGSGSGTDFTFTISSLQPEDFATYSCQQ HDHLPWTFGQGTKVEIK (SEQ ID NO: 87) |
| 457.1, 266.1, 329.1, 426.1, 195.1, 195.2, 195.4 | EIVLTQSPATLSLSPGERATLSCGASQSVSSNYLAWYQQKPGLA PRLLIYGASSRATGVPDRFSGSGSGTDFTLTISRLEPEDFAVYYC QQYGYSYTFGQGTKLEIK (SEQ ID NO: 88) |
| 173.1, 267.1, 102.1, 420.1, 289.1, 410.1, 380.1, 410.2, 173.4, 380.4, 420.4, 371.4, 289.4, 410.4 | DIQMTQSPSSLSASVGDRVTITCQASQDITNYLTWYQQKPGNAP KLLIYDASNLETGVPSRFSGSGSGTDFTFTINSLQPEDVATYFCQ QYDNLPTFGGGTKVEIK (SEQ ID NO: 89) |
| 49 | EIVLTQSPDFQSVTPKEKVTITCRASQSIGSSLHWYQQKPDQSPK LLIKYASQSISGVPSRFSGSGSGTDFTLTINSLEAEDAAAYYCHQ RSSLPQTFGQGTKLEIK (SEQ ID NO: 90) |
| 54 | EIVLTQSPDFQSVTPKEKVTITCRASQSIGSSLHWYQQKPDQSPK LLIKYASQSISGVPSRFSGSGSGTDFTLTINSLEAEDAAAYYCHQ SSCLPQTFGQGTKVEIK (SEQ ID NO: 91) |

TABLE 8-continued

Variable Light Chain Sequences

| Antibody No. | Variable Light Chain Sequence (VL) |
|---|---|
| 55 | EIVLTQSPDFQSVTPKEKVTITCRASQSIGSSLHWYQQKPDQSPKLLIKYASQSISGVPSRFSGSGSGTDFTLTINSLEAEDAAAYYCHQSSSFPQTFGQGTKVEIK (SEQ ID NO: 92) |
| 56 | EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPHTFGQGTKLEIK (SEQ ID NO: 93) |
| 57 | EIVLTQSPDFQSVTPKEKVTITCRASQSIGTSLHWYQQKPDQSPKLLIKYASQSFSGVPSRFSGSGSGTDFTLTINSLEAEDAATYYCHQSSSLPLTFGGGTKVEIK (SEQ ID NO: 94) |
| 58 | EIVLTQSPDFQSVTPKEKVTITCRASQSIGSSLQWYQQKPDQSPKLLIKYASQSFSGVPSRFSGSGSGTDFTLTINSLEAEDAATYYCHQSSSLPPTFGGGTKVEIK (SEQ ID NO: 95) |
| 59 | EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQKFGQGTKVEIK (SEQ ID NO: 96) |
| 60 | EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQPFGQGTKVEIK (SEQ ID NO: 97) |
| 80 | EIVLTQSPATLSLSPGERATLSCRASQSVSYYLAWYQQKPGQAPRLLIYDAFNRATGIPARFSGSGSGTDFTLTISSLEPEDFAVYYCQQRINWPLPFGGGTKVEIK (SEQ ID NO: 98) |
| 92 | EIVLTQSPATLSLSPGERATLSCRASQSVNYYLAWYQQKPGQAPRLLIYDAFNRATGIPARFSGSGSGTDFTLTISSLEPEDFAVYYCQQRISWPLTFGGGTKVEIK (SEQ ID NO: 99) |
| 373.1 | EIVLTQSPATLSLSPGERATLSCRASQSVSHYLAWYQQKPGQAPRLLIYDAFNRATGIPARFSGSGSGTDFTLTISSLEPEDFAVYYCQQRINWPLTFGGGTKVEIK (SEQ ID NO: 100) |
| 467.1 | EIVLTQSPATLSLSPGERATLSCRASQSVSYHLAWYQQKPGQAPRLLIYDAFNRATGIPARFSGSGSGTDFTLTISSLEPEDFAVYYCQQRINWPLTFGGGTKVEIK (SEQ ID NO: 101) |
| 908.1 | EIVLTQSPATLSLSPGERATLSCRASQSVSYYLAWYQQKPGQAPRLLIYHAFNRATGIPARFSGSGSGTDFTLTISSLEPEDFAVYYCQQRINWPLTFGGGTKVEIK (SEQ ID NO: 102) |
| 386.1 | EIVLTQSPATLSLSPGERATLSCRASQSVSYYLAWYQQKPGQAPRLLIYDAFHRATGIPARFSGSGSGTDFTLTISSLEPEDFAVYYCQQRINWPLTFGGGTKVEIK (SEQ ID NO: 103) |
| 268.1 | EIVLTQSPATLSLSPGERATLSCRASQSVSYYLAWYQQKPGQAPRLLIYDAFNRATGIPARFSGSGSGTDFTLTISSLEPEDFAVYYCHQRINWPLTFGGGTKVEIK (SEQ ID NO: 104) |
| 342.1 | EIVLTQSPATLSLSPGERATLSCRASQSVSYYLAWYQQKPGQAPRLLIYDAFNRATGIPARFSGSGSGTDFTLTISSLEPEDFAVYYCQHRINWPLTFGGGTKVEIK (SEQ ID NO: 105) |
| 259.1 | EIVLTQSPATLSLSPGERATLSCRASQSVSYYLAWYQQKPGQAPRLLIYDAFNRATGIPARFSGSGSGTDFTLTISSLEPEDFAVYYCQQRIHWPLTFGGGTKVEIK (SEQ ID NO: 106) |
| 374.1 | DIQMTQSPSSLSASVGDRVTITCQASQHITNYLTWYQQKPGNAPKLLIYDASNLETGVPSRFSGSGSGTDFTFTINSLQPEDVATYFCQQYDNLPTFGGGTKVEIK (SEQ ID NO: 107) |
| 394.1 | DIQMTQSPSSLSASVGDRVTITCQASQDITNYLTWYQQKPGNAPKLLIYHASNLETGVPSRFSGSGSGTDFTFTINSLQPEDVATYFCQQYDNLPTFGGGTKVEIK (SEQ ID NO: 108) |
| 213.1 | DIQMTQSPSSLSASVGDRVTITCQASQDITNYLTWYQQKPGNAPKLLIYDASNLETGVPSRFSGSGSGTDFTFTINSLQPEDVATYFCQQYHNLPTFGGGTKVEIK (SEQ ID NO: 109) |

TABLE 8-continued

| Variable Light Chain Sequences | |
|---|---|
| Antibody No. | Variable Light Chain Sequence (VL) |
| 219.1 | DIQMTQSPSSLSASVGDRVTITCQASQDITNYLTWYQQKPGNAP KLLIYDASNLHTGVPSRFSGSGSGTDFTFTINSLQPEDVATYFCQ QYDNLPTFGGGTKVEIK (SEQ ID NO: 110) |

In specific embodiments, an antibody or an antigen-binding fragment thereof that specifically binds to VISTA comprises a heavy chain and a light chain, wherein the light chain is of the SEQ ID NO: set forth in Table 9 as the light chain for an Antibody No. listed in Table 9, and the heavy chain is of the SEQ ID NO: set forth in Table 9 as the heavy chain of said antibody (e.g., Antibody No. 269.1, Antibody No. 321.1, Antibody No. 245.1, Antibody No. 465.1, Antibody No. 457.1, Antibody No. 173.1, Antibody No. 833.1, Antibody No. 245.4, Antibody No. 465.4, Antibody No. 173.4, Antibody No. 245.2, Antibody No. 289.1 or Antibody No. 420.1).

In specific embodiments, an antibody or an antigen-binding fragment thereof that specifically binds to VISTA comprises a heavy chain and a light chain, wherein the heavy chain has at least 80%, at least 85%, at least 90%, at least 95%, at least 96%, at least 97%, at least 98%, or at least 99% sequence identity to the SEQ ID NO: set forth in Table 9 as the heavy chain for an Antibody No. listed in Table 9. In specific embodiments, an antibody or an antigen-binding fragment thereof that specifically binds to VISTA comprises a heavy chain and a light chain, wherein the light chain has at least 80%, at least 85%, at least 90%, at least 95%, at least 96%, at least 97%, at least 98%, or at least 99% sequence identity to the SEQ ID NO: set forth in Table 9 as the light chain for an Antibody No. listed in Table 9, and the heavy chain has at least 80%, at least 85%, at least 90%, at least 95%, at least 96%, at least 97%, at least 98%, or at least 99% sequence identity to the SEQ ID NO: set forth in Table 9 as the heavy chain of said antibody.

In specific embodiments, an antibody or an antigen-binding fragment thereof that specifically binds to VISTA comprises a heavy chain and a light chain, wherein the heavy chain has at least 95% sequence identity to the SEQ ID NO: set forth in Table 9 as the heavy chain for an Antibody No. listed in Table 9. In specific embodiments, an antibody or an antigen-binding fragment thereof that specifically binds to VISTA comprises a heavy chain and a light chain, wherein the light chain has at least 95% sequence identity to the SEQ ID NO: set forth in Table 9 as the light chain for an Antibody No. listed in Table 9, and the heavy chain has at least 95% sequence identity to the SEQ ID NO: set forth in Table 9 as the heavy chain of said antibody.

The determination of percent identity between two sequences (e.g., amino acid sequences or nucleic acid sequences) can be accomplished using a mathematical algorithm known in the art. The percent identity between two sequences can be determined with or without allowing gaps. In calculating percent identity, typically only exact matches are counted. A specific, non-limiting example of a mathematical algorithm utilized for the comparison of two sequences is the algorithm of Karlin S & Altschul S F (1990) PNAS 87: 2264-2268, modified as in Karlin S & Altschul S F (1993) PNAS 90: 5873-5877. Such an algorithm is incorporated into the NBLAST and XBLAST programs of Altschul S F et al., (1990) J Mol Biol 215: 403. BLAST nucleotide searches can be performed with the NBLAST nucleotide program, and protein searches can be performed with the XBLAST program. To obtain gapped alignments for comparison purposes, Gapped BLAST and/or PSI BLAST can be utilized as described in Altschul S F et al., (1997) Nuc Acids Res 25: 3389 3402. When utilizing BLAST, Gapped BLAST, and PSI Blast programs, the default parameters of the respective programs (e.g., of XBLAST and NBLAST) can be used (see, e.g., National Center for Biotechnology Information (NCBI) on the worldwide web, ncbi.nlm.nih.gov).

TABLE 9

| Antibody heavy and light chain sequences | | |
|---|---|---|
| Antibody No. | Light Chain Sequence | Heavy Chain Sequence |
| 269.1 | MGWSCIILFLVATATGVHS EIVLTQSPDFQSVTPKEKVT ITCRASQSIGSSLHWYQQKP DQSPKLLIKYASQSISGVPS RFSGSGSGTDFTLTINSLEA EDAAAYYCHQSSSLPQTFG QGTKVEIKRTVAAPSVFIFP PSDEQLKSGTASVVCLLNN FYPREAKVQWKVDNALQS GNSQESVTEQDSKDSTYSL SSTLTLSKADYEKHKVYAC EVTHQGLSSPVTKSFNRGE C (SEQ ID NO: 387) | MGWSCIILFLVATATGVHSQVQLVESGGGVVQPGRSLRL SCAASGFTFSSYGMHWVRQAPGKGLEWVADIWYDGSN KHYADSVKGRFTISRDNSKNTLYLQMNSLRAEDTAVYY CARESDYERPYFYYGMDVWGQGTTVTVSSAASTKGPSV FPLAPSSKSTSGGTAALGCLVKDYFPEPVTVSWNSGALTS GVHTFPAVLQSSGLYSLSSVVTVPSSSLGTQTYICNVNHK PSNTKVDKKVEPKSCDKTHTCPPCPAPELLGGPSVFLFPP KPKDTLMISRTPEVTCVVVDVSHEDPEVKFNWYVDGVE VHNAKTKPREEQYNSTYRVVSVLTVLHQDWLNGKEYK CKVSNKALPAPIEKTISKAKGQPREPQVYTLPPSRDELTK NQVSLTCLVKGFYPSDIAVEWESNGQPENNYKTTPPVLD SDGSFFLYSKLTVDKSRWQQGNVFSCSVMHEALHNHYT QKSLSLSPGK (SEQ ID NO: 407) |
| 141.1 | MGWSCIILFLVATATGVHS EIVLTQSPDFQSVTPKEKVT ITCRASQSIGSSLHWYQQKP DQSPKLLIKYASQSISGVPS RFSGSGSGTDFTLTINSLEA EDAAAYYCHQSSSLPQTFG | MGWSCIILFLVATATGVHSQVQLVESGGGVVQPGRSLRL SCAASGFTFSSYGMHWVRQAPGKGLEWVADIWYDGSN KHYADSVKGRFTISRDNSKNTLYLQMNSLRAEDTAVYY CARESDYERPYFYYGMDVWGQGTTVTVSSAASTKGPSV FPLAPSSKSTSGGTAALGCLVKDYFPEPVTVSWNSGALTS GVHTFPAVLQSSGLYSLSSVVTVPSSSLGTQTYICNVNHK |

TABLE 9-continued

Antibody heavy and light chain sequences

| Antibody No. | Light Chain Sequence | Heavy Chain Sequence |
| --- | --- | --- |
| | QGTKVEIKRTVAAPSVFIFP PSDEQLKSGTASVVCLLNN FYPREAKVQWKVDNALQS GNSQESVTEQDSKDSTYSL SSTLTLSKADYEKHKVYAC EVTHQGLSSPVTKSFNRGE C (SEQ ID NO: 387) | PSNTKVDKKVEPKSCDKTHTCPPCPAPELLGGPSVFLFPP KPKDTLMISRTPEVTCVVVDVSHEDPEVKFNWYVDGVE VHNAKTKPREEQYNSTYRVVSVLTVLHQDWLNGKEYK CKVSNKALPAPIEKTISKAKGQPREPQVYTLPPSRDELTK NQVSLTCLVKGFYPSDIAVEWESNGQPENNYKTTPPVLD SDGSFFLYSKLTVDKSRWQQGNVFSCSVLHEALHSHYTQ KSLSLSPGK (SEQ ID NO: 572) |
| 184.1 | MGWSCIILFLVATATGVHS EIVLTQSPDFQSVTPKEKVT ITCRASQSIGSSLHWYQQKP DQSPKLLIKYASQSISGVPS RFSGSGSGTDFTLTINSLEA EDAAAYYCHQSSSLPQTFG QGTKVEIKRTVAAPSVFIFP PSDEQLKSGTASVVCLLNN FYPREAKVQWKVDNALQS GNSQESVTEQDSKDSTYSL SSTLTLSKADYEKHKVYAC EVTHQGLSSPVTKSFNRGE C (SEQ ID NO: 387) | MGWSCIILFLVATATGVHSQVQLVESGGGVVQPGRSLRL SCAASGFTFSSYGMHWVRQAPGKGLEWVADIWYDGSN KHYADSVKGRFTISRDNSKNTLYLQMNSLRAEDTAVYY CARESDYERPYFYYGMDVWGQGTTVTVSSAASTKGPSV FPLAPSSKSTSGGTAALGCLVKDYFPEPVTVSWNSGALTS GVHTFPAVLQSSGLYSLSSVVTVPSSSLGTQTYICNVNHK PSNTKVDKKVEPKSCDKTHTCPPCPAPELLGGPSVFLFPP KPKDTLMISRTPEVTCVVVDVSHEDPEVKFNWYVDGVE VHNAKTKPREQYNSTYRVVSVLTVLHQDWLNGKEYKC KVSNKALPAPIEKTISKAKGQPREPQVYTLPPSRDELTKN QVSLTCLVKGFYPSDIAVEWESNGQPENNYKTTPPVLDS DGSFFLYSKLTVDKSRWQQGNVFSCSVMHEALHNHYTQ KSLSLSPGK (SEQ ID NO: 408) |
| 308.1 | MGWSCIILFLVATATGVHS EIVLTQSPDFQSVTPKEKVT ITCRASQSIGSSLHWYQQKP DQSPKLLIKYASQSISGVPS RFSGSGSGTDFTLTINSLEA EDAAAYYCHQSSSLPQTFG QGTKVEIKRTVAAPSVFIFP PSDEQLKSGTASVVCLLNN FYPREAKVQWKVDNALQS GNSQESVTEQDSKDSTYSL SSTLTLSKADYEKHKVYAC EVTHQGLSSPVTKSFNRGE C (SEQ ID NO: 387) | MGWSCIILFLVATATGVHSQVQLVESGGGVVQPGRSLRL SCAASGFTFSSYGMHWVRQAPGKGLEWVADIWYDGSN KHYADSVKGRFTISRDNSKNTLYLQMNSLRAEDTAVYY CARESDYERPYFYYGMDVWGQGTTVTVSSAASTKGPSV FPLAPSSKSTSGGTAALGCLVKDYFPEPVTVSWNSGALTS GVHTFPAVLQSSGLYSLSSVVTVPSSSLGTQTYICNVNHK PSNTKVDKKVEPKSCDKTHTCPPCPAPELLGGPSVFLFPP KPKDTLYITREPEVTCVVVDVSHEDPEVKFNWYVDGVE VHNAKTKPREEQYNSTYRVVSVLTVLHQDWLNGKEYK CKVSNKALPAPIEKTISKAKGQPREPQVYTLPPSRDELTK NQVSLTCLVKGFYPSDIAVEWESNGQPENNYKTTPPVLD SDGSFFLYSKLTVDKSRWQQGNVFSCSVMHEALHNHYT QKSLSLSPGK (SEQ ID NO: 409) |
| 244.1 | MGWSCIILFLVATATGVHS EIVLTQSPDFQSVTPKEKVT ITCRASQSIGSSLHWYQQKP DQSPKLLIKYASQSISGVPS RFSGSGSGTDFTLTINSLEA EDAAAYYCHQSSSLPQTFG QGTKVEIKRTVAAPSVFIFP PSDEQLKSGTASVVCLLNN FYPREAKVQWKVDNALQS GNSQESVTEQDSKDSTYSL SSTLTLSKADYEKHKVYAC EVTHQGLSSPVTKSFNRGE C (SEQ ID NO: 387) | MGWSCIILFLVATATGVHSQVQLVESGGGVVQPGRSLRL SCAASGFTFSSYGMHWVRQAPGKGLEWVADIWYDGSN KHYADSVKGRFTISRDNSKNTLYLQMNSLRAEDTAVYY CARESDYERPYFYYGMDVWGQGTTVTVSSASTKGPSVF PLAPSSKSTSGGTAALGCLVKDYFPEPVTVSWNSGALTS GVHTFPAVLQSSGLYSLSSVVTVPSSSLGTQTYICNVNHK PSNTKVDKKVEPKSCDKTHTCPPCPAPELLGGPSVFLFPP KPKDTLMISRTPEVTCVVVDVSHEDPEVKFNWYVDGVE VHNAKTKPREEQYNSTYRVVSVLTVLHQDWLNGKEYK CKVSNKALPAPIEKTISKAKGQPREPQVYTLPPSRDELTK NQVSLTCLVKGFYPSDIAVEWESNGQPENNYKTTPPVLD SDGSFFLYSKLTVDKSRWQQGNVFSCSVMHEALHNHYT QKSLSLSPGK (SEQ ID NO: 410) |
| 244.2 | MGWSCIILFLVATATGVHS EIVLTQSPDFQSVTPKEKVT ITCRASQSIGSSLHWYQQKP DQSPKLLIKYASQSISGVPS RFSGSGSGTDFTLTINSLEA EDAAAYYCHQSSSLPQTFG QGTKVEIKRADAAPTVSIFP PSSEQLTSGGASVVCFLNNF YPKDINVKWKIDGSERQNG VLNSWTDQDSKDSTYSMSS TLTLTKDEYERHNSYTCEA THKTSTSPIVKSFNRNEC (SEQ ID NO: 388) | MGWSCIILFLVATATGVHSQVQLVESGGGVVQPGRSLRL SCAASGFTFSSYGMHWVRQAPGKGLEWVADIWYDGSN KHYADSVKGRFTISRDNSKNTLYLQMNSLRAEDTAVYY CARESDYERPYFYYGMDVWGQGTTVTVSSAKTTAPSVY PLAPVCGDTTGSSVTLGCLVKGYFPEPVTLTWNSGSLSS GVHTFPAVLQSDLYTLSSSVTVTSSTWPSQSITCNVAHPA SSTKVDKKIEPRGPTIKPCPPCKCPAPNLLGGPSVFIFPPKI KDVLMISLSPIVTCVVVDVSEDDPDVQISWFVNNVEVHT AQTQTHREDYNSTLRVVSALPIQHQDWMSGKEFKCKVN NKDLPAPIERTISKPKGSVRAPQVYVLPPPEEEMTKKQVT LTCMVTDFMPEDIYVEWTNNGKTELNYKNTEPVLDSDG SYFMYSKLRVEKKNWVERNSYSCSVVHEGLHNHHTTKS FSRTPGK (SEQ ID NO: 411) |
| 244.4 | MGWSCIILFLVATATGVHS EIVLTQSPDFQSVTPKEKVT ITCRASQSIGSSLHWYQQKP DQSPKLLIKYASQSISGVPS RFSGSGSGTDFTLTINSLEA EDAAAYYCHQSSSLPQTFG QGTKVEIKRTVAAPSVFIFP | MGWSCIILFLVATATGVHSQVQLVESGGGVVQPGRSLRL SCAASGFTFSSYGMHWVRQAPGKGLEWVADIWYDGSN KHYADSVKGRFTISRDNSKNTLYLQMNSLRAEDTAVYY CARESDYERPYFYYGMDVWGQGTTVTVSSASTKGPSVF PLAPCSRSTSESTAALGCLVKDYFPEPVTVSWNSGALTSG VHTFPAVLQSSGLYSLSSVVTVPSSSLGTKTYTCNVDHKP SNTKVDKRVESKYGPPCPSCPAPEFLGGPSVFLFPPKPKD |

TABLE 9-continued

Antibody heavy and light chain sequences

| Antibody No. | Light Chain Sequence | Heavy Chain Sequence |
|---|---|---|
| | PSDEQLKSGTASVVCLLNN<br>FYPREAKVQWKVDNALQS<br>GNSQESVTEQDSKDSTYSL<br>SSTLTLSKADYEKHKVYAC<br>EVTHQGLSSPVTKSFNRGE<br>C (SEQ ID NO: 387) | TLMISRTPEVTCVVVDVSQEDPEVQFNWYVDGVEVHNA<br>KTKPREEQFNSTYRVVSVLTVLHQDWLNGKEYKCKVSN<br>KGLPSSIEKTISKAKGQPREPQVYTLPPSQEEMTKNQVSL<br>TCLVKGFYPSDIAVEWESNGQPENNYKTTPPVLDSDGSF<br>FLYSRLTVDKSRWQEGNVFSCSVMHEALHNHYTQKSLS<br>LSLGK (SEQ ID NO: 412) |
| 321.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQCSLKLNSVTTADTAVYYCAR<br>HPVAMNFDDWGQGTLVTVSSAASTKGPSVFPLAPSSKST<br>SGGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 413) |
| 405.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQCSLKLNSVTTADTAVYYCAR<br>HPVAMNFDDWGQGTLVTVSSAASTKGPSVFPLAPSSKST<br>SGGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPEAAGGPSVFLFPPKPKDTLMIS<br>RTPEVTCVVVDVSHEDPEVKFNWYVDGVEVHNAKTKPR<br>EEQYNSTYRVVSVLTVLHQDWLNGKEYKCKVSNKALPA<br>PIEKTISKAKGQPREPQVYTLPPSRDELTKNQVSLTCLVK<br>GFYPSDIAVEWESNGQPENNYKTTPPVLDSDGSFFLYSKL<br>TVDKSRWQQGNVFSCSVMHEALHNHYTQKSLSLSPGK<br>(SEQ ID NO: 414) |
| 472.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQCSLKLNSVTTADTAVYYCAR<br>HPVAMNFDDWGQGTLVTVSSAASTKGPSVFPLAPSSKST<br>SGGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYASTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 415) |
| 430.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQFSLKLNSVTTADTAVYYCAR<br>HPVAMNFDDWGQGTLVTVSSAASTKGPSVFPLAPSSKST<br>SGGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 416) |
| 421.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQASLKLNSVTTADTAVYYCAR<br>HPVAMNFDDWGQGTLVTVSSAASTKGPSVFPLAPSSKST<br>SGGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP |

TABLE 9-continued

Antibody heavy and light chain sequences

| Antibody No. | Light Chain Sequence | Heavy Chain Sequence |
|---|---|---|
| | SGNSQESVTEQDSKDSTYS<br>LSSTLTLSKADYEKHKVYA<br>CEVTHQGLSSPVTKSFNRG<br>EC (SEQ ID NO: 389) | IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 417) |
| 139.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQSSLKLNSVTTADTAVYYCAR<br>HPVAMNFDDWGQGTLVTVSSAASTKGPSVFPLAPSSKST<br>SGGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 418) |
| 178.1 | IMGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQASLKLNSVTTADTAVYYCAR<br>HPVAMNFDDWGQGTLVTVSSASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 419) |
| 391.1 | IMGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQASLKLNSVTTADTAVYYCAR<br>HPVAMNFDDWGQGTLVTVSSASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVLHEALHSHYTQKSLSLSPGK<br>(SEQ ID NO: 420) |
| 347.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQASLKLNSVTTADTAVYYCAR<br>HPVAMNFDDWGQGTLVTVSSASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLYITR<br>EPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 421) |
| 427.1 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQASLKLNSVTTADTAVYYCAR<br>HPVAMNFDDWGQGTLVTVSSASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>QYNSTYRVVSVLTVLHQDWLNGKEYKCKVSNKALPAPI<br>EKTISKAKGQPREPQVYTLPPSRDELTKNQVSLTCLVKGF<br>YPSDIAVEWESNGQPENNYKTTPPVLDSDGSFFLYSKLTV<br>DKSRWQQGNVFSCSVMHEALHNHYTQKSLSLSPGK<br>(SEQ ID NO: 422) |

TABLE 9-continued

| Antibody heavy and light chain sequences | | |
|---|---|---|
| Antibody No. | Light Chain Sequence | Heavy Chain Sequence |
| 178.2 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRADAAPTVSIF<br>PPSSEQLTSGGASVVCFLNN<br>FYPKDINVKWKIDGSERQN<br>GVLNSWTDQDSKDSTYSM<br>SSTLTLTKDEYERHNSYTC<br>EATHKTSTSPIVKSFNRNEC<br>(SEQ ID NO: 390) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQASLKLNSVTTADTAVYYCAR<br>HPVAMNFDDWGQGTLVTVSSAKTTAPSVYPLAPVCGDT<br>TGSSVTLGCLVKGYFPEPVTLTWNSGSLSSGVHTFPAVL<br>QSDLYTLSSSVTVTSSTWPSQSITCNVAHPASSTKVDKKI<br>EPRGPTIKPCPPCKCPAPNLLGGPSVFIFPPKIKDVLMISLS<br>PIVTCVVVDVSEDDPDVQISWFVNNVEVHTAQTQTHRED<br>YNSTLRVVSALPIQHQDWMSGKEFKCKVNNKDLPAPIER<br>TISKPKGSVRAPQVYVLPPPEEEMTKKQVTLTCMVTDFM<br>PEDIYVEWTNNGKTELNYKNTEPVLDSDGSYFMYSKLR<br>VEKKNWVERNSYSCSVVHEGLHNHHTTKSFSRTPGK<br>(SEQ ID NO: 423) |
| 178.4 | MGWSCIILFLVATATGVHS<br>DIQMTQSPSSLSASVGDRV<br>TITCRASQGISSWLAWYQQ<br>KPEKAPKSLIYAASSLQSGV<br>PSRFSGSGSGTDFTLTISSLQ<br>PEDFATYYCQQYNSYPYTF<br>GQGTKLEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 389) | MGWSCIILFLVATATGVHSQLQLQESGPGLVKPSETLSLT<br>CTVSGGSISSSGYYWGWIRQPPGKGLEWIGSLYSSGYTY<br>YNPSLKSRVTISVDTSKNQASLKLNSVTTADTAVYYCAR<br>HPVAMNFDDWGQGTLVTVSSASTKGPSVFPLAPCSRSTS<br>ESTAALGCLVKDYFPEPVTVSWNSGALTSGVHTFPAVLQ<br>SSGLYSLSSVVTVPSSSLGTKTYTCNVDHKPSNTKVDKR<br>VESKYGPPCPSCPAPEFLGGPSVFLFPPKPKDTLMISRTPE<br>VTCVVVDVSQEDPEVQFNWYVDGVEVHNAKTKPREEQ<br>FNSTYRVVSVLTVLHQDWLNGKEYKCKVSNKGLPSSIEK<br>TISKAKGQPREPQVYTLPPSQEEMTKNQVSLTCLVKGFY<br>PSDIAVEWESNGQPENNYKTTPPVLDSDGSFFLYSRLTVD<br>KSRWQEGNVFSCSVMHEALHNHYTQKSLSLSLGK (SEQ<br>ID NO: 424) |
| 245.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSAASTKGPSVFPLAPSSKSTSGGTA<br>ALGCLVKDYFPEPVTVSWNSGALTSGVHTFPAVLQSSGL<br>YSLSSVVTVPSSSLGTQTYICNVNHKPSNTKVDKKVEPKS<br>CDKTHTCPPCPAPELLGGPSVFLFPPKPKDTLMISRTPEVT<br>CVVVDVSHEDPEVKFNWYVDGVEVHNAKTKPREEQYN<br>STYRVVSVLTVLHQDWLNGKEYKCKVSNKALPAPIEKTI<br>SKAKGQPREPQVYTLPPSRDELTKNQVSLTCLVKGFYPS<br>DIAVEWESNGQPENNYKTTPPVLDSDGSFFLYSKLTVDK<br>SRWQQGNVFSCSVMHEALHNHYTQKSLSLSPGK (SEQ<br>ID NO: 425) |
| 475.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSAASTKGPSVFPLAPSSKSTSGGTA<br>ALGCLVKDYFPEPVTVSWNSGALTSGVHTFPAVLQSSGL<br>YSLSSVVTVPSSSLGTQTYICNVNHKPSNTKVDKKVEPKS<br>CDKTHTCPPCPAPELLGGPSVFLFPPKPKDTLMISRTPEVT<br>CVVVDVSHEDPEVKFNWYVDGVEVHNAKTKPREEQYN<br>STYRVVSVLTVLHQDWLNGKEYKCKVSNKALPAPIEKTI<br>SKAKGQPREPQVYTLPPSRDELTKNQVSLTCLVKGFYPS<br>DIAVEWESNGQPENNYKTTPPVLDSDGSFFLYSKLTVDK<br>SRWQQGNVFSCSVLHEALHSHYTQKSLSLSPGK (SEQ ID<br>NO: 426) |
| 149.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSAASTKGPSVFPLAPSSKSTSGGTA<br>ALGCLVKDYFPEPVTVSWNSGALTSGVHTFPAVLQSSGL<br>YSLSSVVTVPSSSLGTQTYICNVNHKPSNTKVDKKVEPKS<br>CDKTHTCPPCPAPELLGGPSVFLFPPKPKDTLYITREPEVT<br>CVVVDVSHEDPEVKFNWYVDGVEVHNAKTKPREEQYN<br>STYRVVSVLTVLHQDWLNGKEYKCKVSNKALPAPIEKTI<br>SKAKGQPREPQVYTLPPSRDELTKNQVSLTCLVKGFYPS<br>DIAVEWESNGQPENNYKTTPPVLDSDGSFFLYSKLTVDK<br>SRWQQGNVFSCSVMHEALHNHYTQKSLSLSPGK (SEQ<br>ID NO: 427) |
| 133.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSAASTKGPSVFPLAPSSKSTSGGTA<br>ALGCLVKDYFPEPVTVSWNSGALTSGVHTFPAVLQSSGL |

TABLE 9-continued

Antibody heavy and light chain sequences

| Antibody No. | Light Chain Sequence | Heavy Chain Sequence |
|---|---|---|
| | PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 391) | YSLSSVVTVPSSSLGTQTYICNVNHKPSNTKVDKKVEPKS CDKTHTCPPCPAPELLGGPSVFLFPPKPKDTLMISRTPEVT CVVVDVSHEDPEVKFNWYVDGVEVHNAKTKPREQYNS TYRVVSVLTVLHQDWLNGKEYKCKVSNKALPAPIEKTIS KAKGQPREPQVYTLPPSRDELTKNQVSLTCLVKGFYPSDI AVEWESNGQPENNYKTTPPVLDSDGSFFLYSKLTVDKSR WQQGNVFSCSVMHEALHNHYTQKSLSLSPGK (SEQ ID NO: 428) |
| 474.1 | MGWSCIILFLVATATGVHS EIVLTQSPATLSLSPGERAT LSCRASQSVSYYLAWYQQ KPGQAPRLLIYDAFNRATGI PARFSGSGSGTDFTLTISSLE PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 391) | MGWSCIILFLVATATGVHSQVQLQESGPGLVKPSETLSLT CTVSGGSISSYYWSWIRQPPGKGLEWIGYIYYSGSTNYNP SLKSRVTISVDTSKSQFSLKLSSVTAADTAVYYCARDIPA FAFDIWGQGTMVIVSSASTKGPSVFPLAPSSKSTSGGTAA LGCLVKDYFPEPVTVSWNSGALTSGVHTFPAVLQSSGLY SLSSVVTVPSSSLGTQTYICNVNHKPSNTKVDKKVEPKSC DKTHTCPPCPAPELLGGPSVFLFPPKPKDTLMISRTPEVTC VVVDVSHEDPEVKFNWYVDGVEVHNAKTKPREEQYNS TYRVVSVLTVLHQDWLNGKEYKCKVSNKALPAPIEKTIS KAKGQPREPQVYTLPPSRDELTKNQVSLTCLVKGFYPSDI AVEWESNGQPENNYKTTPPVLDSDGSFFLYSKLTVDKSR WQQGNVFSCSVMHEALHNHYTQKSLSLSPGK (SEQ ID NO: 429) |
| 373.1 | MGWSCIILFLVATATGVHS EIVLTQSPATLSLSPGERAT LSCRASQSVSHYLAWYQQ KPGQAPRLLIYDAFNRATGI PARFSGSGSGTDFTLTISSLE PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 393) | MGWSCIILFLVATATGVHSQVQLQESGPGLVKPSETLSLT CTVSGGSISSYYWSWIRQPPGKGLEWIGYIYYSGSTNYNP SLKSRVTISVDTSKSQFSLKLSSVTAADTAVYYCARDIPA FAFDIWGQGTMVIVSSASTKGPSVFPLAPSSKSTSGGTAA LGCLVKDYFPEPVTVSWNSGALTSGVHTFPAVLQSSGLY SLSSVVTVPSSSLGTQTYICNVNHKPSNTKVDKKVEPKSC DKTHTCPPCPAPELLGGPSVFLFPPKPKDTLMISRTPEVTC VVVDVSHEDPEVKFNWYVDGVEVHNAKTKPREEQYNS TYRVVSVLTVLHQDWLNGKEYKCKVSNKALPAPIEKTIS KAKGQPREPQVYTLPPSRDELTKNQVSLTCLVKGFYPSDI AVEWESNGQPENNYKTTPPVLDSDGSFFLYSKLTVDKSR WQQGNVFSCSVMHEALHNHYTQKSLSLSPGK (SEQ ID NO: 429) |
| 467.1 | MGWSCIILFLVATATGVHS EIVLTQSPATLSLSPGERAT LSCRASQSVSYHLAWYQQ KPGQAPRLLIYDAFNRATGI PARFSGSGSGTDFTLTISSLE PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 394) | MGWSCIILFLVATATGVHSQVQLQESGPGLVKPSETLSLT CTVSGGSISSYYWSWIRQPPGKGLEWIGYIYYSGSTNYNP SLKSRVTISVDTSKSQFSLKLSSVTAADTAVYYCARDIPA FAFDIWGQGTMVIVSSASTKGPSVFPLAPSSKSTSGGTAA LGCLVKDYFPEPVTVSWNSGALTSGVHTFPAVLQSSGLY SLSSVVTVPSSSLGTQTYICNVNHKPSNTKVDKKVEPKSC DKTHTCPPCPAPELLGGPSVFLFPPKPKDTLMISRTPEVTC VVVDVSHEDPEVKFNWYVDGVEVHNAKTKPREEQYNS TYRVVSVLTVLHQDWLNGKEYKCKVSNKALPAPIEKTIS KAKGQPREPQVYTLPPSRDELTKNQVSLTCLVKGFYPSDI AVEWESNGQPENNYKTTPPVLDSDGSFFLYSKLTVDKSR WQQGNVFSCSVMHEALHNHYTQKSLSLSPGK (SEQ ID NO: 429) |
| 908.1 | IMGWSCIILFLVATATGVHS EIVLTQSPATLSLSPGERAT LSCRASQSVSYYLAWYQQ KPGQAPRLLIYHAFNRATGI PARFSGSGSGTDFTLTISSLE PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 395) | MGWSCIILFLVATATGVHSQVQLQESGPGLVKPSETLSLT CTVSGGSISSYYWSWIRQPPGKGLEWIGYIYYSGSTNYNP SLKSRVTISVDTSKSQFSLKLSSVTAADTAVYYCARDIPA FAFDIWGQGTMVIVSSASTKGPSVFPLAPSSKSTSGGTAA LGCLVKDYFPEPVTVSWNSGALTSGVHTFPAVLQSSGLY SLSSVVTVPSSSLGTQTYICNVNHKPSNTKVDKKVEPKSC DKTHTCPPCPAPELLGGPSVFLFPPKPKDTLMISRTPEVTC VVVDVSHEDPEVKFNWYVDGVEVHNAKTKPREEQYNS TYRVVSVLTVLHQDWLNGKEYKCKVSNKALPAPIEKTIS KAKGQPREPQVYTLPPSRDELTKNQVSLTCLVKGFYPSDI AVEWESNGQPENNYKTTPPVLDSDGSFFLYSKLTVDKSR WQQGNVFSCSVMHEALHNHYTQKSLSLSPGK (SEQ ID NO: 429) |
| 386.1 | MGWSCIILFLVATATGVHS EIVLTQSPATLSLSPGERAT LSCRASQSVSYYLAWYQQ KPGQAPRLLIYDAFHRATGI PARFSGSGSGTDFTLTISSLE PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS | MGWSCIILFLVATATGVHSQVQLQESGPGLVKPSETLSLT CTVSGGSISSYYWSWIRQPPGKGLEWIGYIYYSGSTNYNP SLKSRVTISVDTSKSQFSLKLSSVTAADTAVYYCARDIPA FAFDIWGQGTMVIVSSASTKGPSVFPLAPSSKSTSGGTAA LGCLVKDYFPEPVTVSWNSGALTSGVHTFPAVLQSSGLY SLSSVVTVPSSSLGTQTYICNVNHKPSNTKVDKKVEPKSC DKTHTCPPCPAPELLGGPSVFLFPPKPKDTLMISRTPEVTC VVVDVSHEDPEVKFNWYVDGVEVHNAKTKPREEQYNS TYRVVSVLTVLHQDWLNGKEYKCKVSNKALPAPIEKTIS KAKGQPREPQVYTLPPSRDELTKNQVSLTCLVKGFYPSDI |

TABLE 9-continued

Antibody heavy and light chain sequences

| Antibody No. | Light Chain Sequence | Heavy Chain Sequence |
|---|---|---|
| | LSSTLTLSKADYEKHKVYA<br>CEVTHQGLSSPVTKSFNRG<br>EC (SEQ ID NO: 396) | AVEWESNGQPENNYKTTPPVLDSDGSFFLYSKLTVDKSR<br>WQQGNVFSCSVMHEALHNHYTQKSLSLSPGK (SEQ ID<br>NO: 429) |
| 268.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCHQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 397) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 429) |
| 342.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQHRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 398) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 429) |
| 259.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRIHWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 399) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 429) |
| 338.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSHYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 430) |
| 419.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYHWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 431) |

TABLE 9-continued

Antibody heavy and light chain sequences

| Antibody No. | Light Chain Sequence | Heavy Chain Sequence |
|---|---|---|
| 277.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGHIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 432) |
| 946.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIHYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 433) |
| 322.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYHSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 434) |
| 346.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTHYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 435) |
| 304.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNHNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 436) |
| 814.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE | MGWSCIILFLVATATGVHSQVQLQESGPGLVKPSETLSLT<br>CTVSGGSISSYYWSWIRQPPGKGLEWIGYIYYSGSTNYHP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY |

TABLE 9-continued

Antibody heavy and light chain sequences

| Antibody No. | Light Chain Sequence | Heavy Chain Sequence |
|---|---|---|
| | PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 437) |
| 210.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARHIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 438) |
| 460.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFHIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 439) |
| 245.2 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRADAAPTVSIF<br>PPSSEQLTSGGASVVCFLNN<br>FYPKDINVKWKIDGSERQN<br>GVLNSWTDQDSKDSTYSM<br>SSTLTLTKDEYERHNSYTC<br>EATHKTSTSPIVKSFNRNEC<br>(SEQ ID NO: 392) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSAKTTAPSVYPLAPVCGDTTGSS<br>VTLGCLVKGYFPEPVTLTWNSGSLSSGVHTFPAVLQSDL<br>YTLSSSVTVTSSTWPSQSITCNVAHPASSTKVDKKIEPRGP<br>TIKPCPPCKCPAPNLLGGPSVFIFPPKIKDVLMISLSPIVTC<br>VVVDVSEDDPDVQISWFVNNVEVHTAQTQTHREDYNST<br>LRVVSALPIQHQDWMSGKEFKCKVNNKDLPAPIERTISK<br>PKGSVRAPQVYVLPPPEEEMTKKQVTLTCMVTDFMPEDI<br>YVEWTNNGKTELNYKNTEPVLDSDGSYFMYSKLRVEKK<br>NWVERNSYSCSVVHEGLHNHHTTKSFSRTPGK (SEQ ID<br>NO: 440) |
| 474.2 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRADAAPTVSIF<br>PPSSEQLTSGGASVVCFLNN<br>FYPKDINVKWKIDGSERQN<br>GVLNSWTDQDSKDSTYSM<br>SSTLTLTKDEYERHNSYTC<br>EATHKTSTSPIVKSFNRNEC<br>(SEQ ID NO: 392) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSAKTTAPSVYPLAPVCGDTTGSSV<br>TLGCLVKGYFPEPVTLTWNSGSLSSGVHTFPAVLQSDLY<br>TLSSSVTVTSSTWPSQSITCNVAHPASSTKVDKKIEPRGPT<br>IKPCPPCKCPAPNLLGGPSVFIFPPKIKDVLMISLSPIVTCV<br>VVDVSEDDPDVQISWFVNNVEVHTAQTQTHREDYNSTL<br>RVVSALPIQHQDWMSGKEFKCKVNNKDLPAPIERTISKP<br>KGSVRAPQVYVLPPPEEEMTKKQVTLTCMVTDFMPEDIY<br>VEWTNNGKTELNYKNTEPVLDSDGSYFMYSKLRVEKKN<br>WVERNSYSCSVVHEGLHNHHTTKSFSRTPGK (SEQ ID<br>NO: 441) |
| 542.2 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRADAAPTVSIF<br>PPSSEQLTSGGASVVCFLNN<br>FYPKDINVKWKIDGSERQN<br>GVLNSWTDQDSKDSTYSM | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSAKTTAPSVYPLAPVCGDTTGSSV<br>TLGCLVKGYFPEPVTLTWNSGSLSSGVHTFPAVLQSDLY<br>TLSSSVTVTSSTWPSQSITCNVAHPASSTKVDKKIEPRGPT<br>IKPCPPCKCPAPNAAGGPSVFIFPPKIKDVLMISLSPIVTCV<br>VVDVSEDDPDVQISWFVNNVEVHTAQTQTHREDYNSTL<br>RVVSALPIQHQDWMSGKEFKCKVNNKDLPAPIERTISKP<br>KGSVRAPQVYVLPPPEEEMTKKQVTLTCMVTDFMPEDIY |

TABLE 9-continued

Antibody heavy and light chain sequences

| Antibody No. | Light Chain Sequence | Heavy Chain Sequence |
|---|---|---|
| | SSTLTLTKDEYERHNSYTC EATHKTSTSPIVKSFNRNEC (SEQ ID NO: 392) | VEWTNNGKTELNYKNTEPVLDSDGSYFMYSKLRVEKKN WVERNSYSCSVVHEGLHNHHTTKSFSRTPGK (SEQ ID NO: 442) |
| 245.4 | MGWSCIILFLVATATGVHS EIVLTQSPATLSLSPGERAT LSCRASQSVSYYLAWYQQ KPGQAPRLLIYDAFNRATGI PARFSGSGSGTDFTLTISSLE PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 391) | MGWSCIILFLVATATGVHSQVQLQESGPGLVKPSETLSLT CTVSGGSISSYYWSWIRQPPGKGLEWIGYIYYSGSTNYNP SLKSRVTISVDTSKSQFSLKLSSVTAADTAVYYCARDIPA FAFDIWGQGTMVIVSSAASTKGPSVFPLAPCSRSTSESTA ALGCLVKDYFPEPVTVSWNSGALTSGVHTFPAVLQSSGL YSLSSVVTVPSSSLGTKTYTCNVDHKPSNTKVDKRVESK YGPPCPSCPAPEFLGGPSVFLFPPKPKDTLMISRTPEVTCV VVDVSQEDPEVQFNWYVDGVEVHNAKTKPREEQFNSTY RVVSVLTVLHQDWLNGKEYKCKVSNKGLPSSIEKTISKA KGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGK (SEQ ID NO: 443) |
| 474.4 | MGWSCIILFLVATATGVHS EIVLTQSPATLSLSPGERAT LSCRASQSVSYYLAWYQQ KPGQAPRLLIYDAFNRATGI PARFSGSGSGTDFTLTISSLE PEDFAVYYCQQRINWPLTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 391) | MGWSCIILFLVATATGVHSQVQLQESGPGLVKPSETLSLT CTVSGGSISSYYWSWIRQPPGKGLEWIGYIYYSGSTNYNP SLKSRVTISVDTSKSQFSLKLSSVTAADTAVYYCARDIPA FAFDIWGQGTMVIVSSASTKGPSVFPLAPCSRSTSESTAA LGCLVKDYFPEPVTVSWNSGALTSGVHTFPAVLQSSGLY SLSSVVTVPSSSLGTKTYTCNVDHKPSNTKVDKRVESKY GPPCPSCPAPEFLGGPSVFLFPPKPKDTLMISRTPEVTCVV VDVSQEDPEVQFNWYVDGVEVHNAKTKPREEQFNSTYR VVSVLTVLHQDWLNGKEYKCKVSNKGLPSSIEKTISKAK GQPREPQVYTLPPSQEEMTKNQVSLTCLVKGFYPSDIAV EWESNGQPENNYKTTPPVLDSDGSFFLYSRLTVDKSRWQ EGNVFSCSVMHEALHNHYTQKSLSLSLGK (SEQ ID NO: 444) |
| 465.1 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRTVAAPSVFI FPPSDEQLKSGTASVVCLL NNFYPREAKVQWKVDNAL QSGNSQESVTEQDSKDSTY SLSSTLTLSKADYEKHKVY ACEVTHQGLSSPVTKSFNR GEC (SEQ ID NO: 400) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSAASTKGPSVFPLAPSSKS TSGGTAALGCLVKDYFPEPVTVSWNSGALTSGVHTFPAV LQSSGLYSLSSVVTVPSSSLGTQTYICNVNHKPSNTKVDK KVEPKSCDKTHTCPPCPAPELLGGPSVFLFPPKPKDTLMIS RTPEVTCVVVDVSHEDPEVKFNWYVDGVEVHNAKTKPR EEQYNSTYRVVSVLTVLHQDWLNGKEYKCKVSNKALPA PIEKTISKAKGQPREPQVYTLPPSRDELTKNQVSLTCLVK GFYPSDIAVEWESNGQPENNYKTTPPVLDSDGSFFLYSKL TVDKSRWQQGNVFSCSVMHEALHNHYTQKSLSLSPGK (SEQ ID NO: 445) |
| 341.1 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRTVAAPSVFI FPPSDEQLKSGTASVVCLL NNFYPREAKVQWKVDNAL QSGNSQESVTEQDSKDSTY SLSSTLTLSKADYEKHKVY ACEVTHQGLSSPVTKSFNR GEC (SEQ ID NO: 400) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSAASTKGPSVFPLAPSSKS TSGGTAALGCLVKDYFPEPVTVSWNSGALTSGVHTFPAV LQSSGLYSLSSVVTVPSSSLGTQTYICNVNHKPSNTKVDK KVEPKSCDKTHTCPPCPAPELLGGPSVFLFPPKPKDTLMIS RTPEVTCVVVDVSHEDPEVKFNWYVDGVEVHNAKTKPR EEQYNSTYRVVSVLTVLHQDWLNGKEYKCKVSNKALPA PIEKTISKAKGQPREPQVYTLPPSRDELTKNQVSLTCLVK GFYPSDIAVEWESNGQPENNYKTTPPVLDSDGSFFLYSKL TVDKSRWQQGNVFSCSVLHEALHSHYTQKSLSLSPGK (SEQ ID NO: 446) |
| 228.1 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRTVAAPSVFI FPPSDEQLKSGTASVVCLL NNFYPREAKVQWKVDNAL QSGNSQESVTEQDSKDSTY SLSSTLTLSKADYEKHKVY ACEVTHQGLSSPVTKSFNR GEC (SEQ ID NO: 400) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSAASTKGPSVFPLAPSSKS TSGGTAALGCLVKDYFPEPVTVSWNSGALTSGVHTFPAV LQSSGLYSLSSVVTVPSSSLGTQTYICNVNHKPSNTKVDK KVEPKSCDKTHTCPPCPAPELLGGPSVFLFPPKPKDTLMIS RTPEVTCVVVDVSHEDPEVKFNWYVDGVEVHNAKTKPR EQYNSTYRVVSVLTVLHQDWLNGKEYKCKVSNKALPAP IEKTISKAKGQPREPQVYTLPPSRDELTKNQVSLTCLVKG FYPSDIAVEWESNGQPENNYKTTPPVLDSDGSFFLYSKLT VDKSRWQQGNVFSCSVMHEALHNHYTQKSLSLSPGK (SEQ ID NO: 447) |

TABLE 9-continued

Antibody heavy and light chain sequences

| Antibody No. | Light Chain Sequence | Heavy Chain Sequence |
|---|---|---|
| 444.1 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRTVAAPSVFI FPPSDEQLKSGTASVVCLL NNFYPREAKVQWKVDNAL QSGNSQESVTEQDSKDSTY SLSSTLTLSKADYEKHKVY ACEVTHQGLSSPVTKSFNR GEC (SEQ ID NO: 400) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSAASTKGPSVFPLAPSSKS TSGGTAALGCLVKDYFPEPVTVSWNSGALTSGVHTFPAV LQSSGLYSLSSVVTVPSSSLGTQTYICNVNHKPSNTKVDK KVEPKSCDKTHTCPPCPAPEAAGGPSVFLFPPKPKDTLMI SRTPEVTCVVVDVSHEDPEVKFNWYVDGVEVHNAKTKP REEQYNSTYRVVSVLTVLHQDWLNGKEYKCKVSNKALP APIEKTISKAKGQPREPQVYTLPPSRDELTKNQVSLTCLV KGFYPSDIAVEWESNGQPENNYKTTPPVLDSDGSFFLYS KLTVDKSRWQQGNVFSCSVMHEALHNHYTQKSLSLSPG K (SEQ ID NO: 448) |
| 395.1 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRTVAAPSVFI FPPSDEQLKSGTASVVCLL NNFYPREAKVQWKVDNAL QSGNSQESVTEQDSKDSTY SLSSTLTLSKADYEKHKVY ACEVTHQGLSSPVTKSFNR GEC (SEQ ID NO: 400) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSAASTKGPSVFPLAPSSKS TSGGTAALGCLVKDYFPEPVTVSWNSGALTSGVHTFPAV LQSSGLYSLSSVVTVPSSSLGTQTYICNVNHKPSNTKVDK KVEPKSCDKTHTCPPCPAPELLGGPSVFLFPPKPKDTLYIT REPEVTCVVVDVSHEDPEVKFNWYVDGVEVHNAKTKPR EEQYNSTYRVVSVLTVLHQDWLNGKEYKCKVSNKALPA PIEKTISKAKGQPREPQVYTLPPSRDELTKNQVSLTCLVK GFYPSDIAVEWESNGQPENNYKTTPPVLDSDGSFFLYSKL TVDKSRWQQGNVFSCSVMHEALHNHYTQKSLSLSPGK (SEQ ID NO: 449) |
| 564.2 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRADAAPTVSI FPPSSEQLTSGGASVVCFLN NFYPKDINVKWKIDGSERQ NGVLNSWTDQDSKDSTYS MSSTLTLTKDEYERHNSYT CEATHKTSTSPIVKSFNRNE C (SEQ ID NO: 569) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSAKTTAPSVYPLAPVCGD TTGSSVTLGCLVKGYFPEPVTLTWNSGSLSSGVHTFPAVL QSDLYTLSSSVTVTSSTWPSQSITCNVAHPASSTKVDKKI EPRGPTIKPCPPCKCPAPNLLGGPSVFIFPPKIKDVLMISLS PIVTCVVVDVSEDDPDVQISWFVNNVEVHTAQTQTHRED YNSTLRVVSALPIQHQDWMSGKEFKCKVNNKDLPAPIER TISKPKGSVRAPQVYVLPPPEEEMTKKQVTLTCMVTDFM PEDIYVEWTNNGKTELNYKNTEPVLDSDGSYFMYSKLR VEKKNWVERNSYSCSVVHEGLHNHHTTKSFSRTPGK (SEQ ID NO: 450) |
| 465.4 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRTVAAPSVFI FPPSDEQLKSGTASVVCLL NNFYPREAKVQWKVDNAL QSGNSQESVTEQDSKDSTY SLSSTLTLSKADYEKHKVY ACEVTHQGLSSPVTKSFNR GEC (SEQ ID NO: 400) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSAASTKGPSVFPLAPCSRS TSESTAALGCLVKDYFPEPVTVSWNSGALTSGVHTFPAV LQSSGLYSLSSVVTVPSSSLGTKTYTCNVDHKPSNTKVD KRVESKYGPPCPSCPAPEFLGGPSVFLFPPKPKDTLMISRT PEVTCVVVDVSQEDPEVQFNWYVDGVEVHNAKTKPREE QFNSTYRVVSVLTVLHQDWLNGKEYKCKVSNKGLPSSIE KTISKAKGQPREPQVYTLPPSQEEMTKNQVSLTCLVKGF YPSDIAVEWESNGQPENNYKTTPPVLDSDGSFFLYSRLTV DKSRWQEGNVFSCSVMHEALHNHYTQKSLSLSLGK (SEQ ID NO: 451) |
| 564.4 | MGWSCIILFLVATATGVHS DIQMTQSPSSLSASVGDRV TITCQASQDISNYLNWYQQ KPGRAPELLIYDASNLETG VPSRFSGSGSGTDFTFTISSL QPEDFATYSCQQHDHLPWT FGQGTKVEIKRTVAAPSVFI FPPSDEQLKSGTASVVCLL NNFYPREAKVQWKVDNAL QSGNSQESVTEQDSKDSTY SLSSTLTLSKADYEKHKVY ACEVTHQGLSSPVTKSFNR GEC (SEQ ID NO: 400) | MGWSCIILFLVATATGVHSEVQLVESGGGLIQPGGSLRFS CAASGFTFSSYAMNWVRQAPGKGLEWVSAISGSGGITY YADSVKGRFTISRDNSKNTLYLQMNSLRAEDTAVYYCA RDWELGRFDYWGQGTLVTVSSASTKGPSVFPLAPCSRST SESTAALGCLVKDYFPEPVTVSWNSGALTSGVHTFPAVL QSSGLYSLSSVVTVPSSSLGTKTYTCNVDHKPSNTKVDK RVESKYGPPCPSCPAPEFLGGPSVFLFPPKPKDTLMISRTP EVTCVVVDVSQEDPEVQFNWYVDGVEVHNAKTKPREE QFNSTYRVVSVLTVLHQDWLNGKEYKCKVSNKGLPSSIE KTISKAKGQPREPQVYTLPPSQEEMTKNQVSLTCLVKGF YPSDIAVEWESNGQPENNYKTTPPVLDSDGSFFLYSRLTV DKSRWQEGNVFSCSVMHEALHNHYTQKSLSLSLGK (SEQ ID NO: 452) |
| 457.1 | MGWSCIILFLVATATGVHS EIVLTQSPATLSLSPGERAT LSCGASQSVSSNYLAWYQ QKPGLAPRLLIYGASSRAT GVPDRFSGSGSGTDFTLTIS | MGWSCIILFLVATATGVHSEVQLVESGGGLVQPGGSLRL SCAASGFTFSSYAMSWVRQAPGKGLEWVSVISGSGGITY YSDSVKGRFTISRDNSKNTLYLQMNSLRAEDTAVYYCA KDWEFFWYFDLWGRGTLVTVSSAASTKGPSVFPLAPSSK STSGGTAALGCLVKDYFPEPVTVSWNSGALTSGVHTFPA |

TABLE 9-continued

Antibody heavy and light chain sequences

| Antibody No. | Light Chain Sequence | Heavy Chain Sequence |
|---|---|---|
| | RLEPEDFAVYYCQQYGYSY | VLQSSGLYSLSSVVTVPSSSLGTQTYICNVNHKPSNTKVD |
| | TFGQGTKLEIKRTVAAPSVF | KKVEPKSCDKTHTCPPCPAPELLGGPSVFLFPPKPKDTLM |
| | IFPPSDEQLKSGTASVVCLL | ISRTPEVTCVVVDVSHEDPEVKFNWYVDGVEVHNAKTK |
| | NNFYPREAKVQWKVDNAL | PREEQYNSTYRVVSVLTVLHQDWLNGKEYKCKVSNKAL |
| | QSGNSQESVTEQDSKDSTY | PAPIEKTISKAKGQPREPQVYTLPPSRDELTKNQVSLTCL |
| | SLSSTLTLSKADYEKHKVY | VKGFYPSDIAVEWESNGQPENNYKTTPPVLDSDGSFFLY |
| | ACEVTHQGLSSPVTKSFNR | SKLTVDKSRWQQGNVFSCSVMHEALHNHYTQKSLSLSP |
| | GEC (SEQ ID NO: 401) | GK (SEQ ID NO: 453) |
| 266.1 | MGWSCIILFLVATATGVHS | MGWSCIILFLVATATGVHSEVQLVESGGGLVQPGGSLRL |
| | EIVLTQSPATLSLSPGERAT | SCAASGFTFSSYAMSWVRQAPGKGLEWVSVISGSGGITY |
| | LSCGASQSVSSNYLAWYQ | YSDSVKGRFTISRDNSKNTLYLQMNSLRAEDTAVYYCA |
| | QKPGLAPRLLIYGASSRAT | KDWEFFWYFDLWGRGTLVTVSSAASTKGPSVFPLAPSSK |
| | GVPDRFSGSGSGTDFTLTIS | STSGGTAALGCLVKDYFPEPVTVSWNSGALTSGVHTFPA |
| | RLEPEDFAVYYCQQYGYSY | VLQSSGLYSLSSVVTVPSSSLGTQTYICNVNHKPSNTKVD |
| | TFGQGTKLEIKRTVAAPSVF | KKVEPKSCDKTHTCPPCPAPELLGGPSVFLFPPKPKDTLM |
| | IFPPSDEQLKSGTASVVCLL | ISRTPEVTCVVVDVSHEDPEVKFNWYVDGVEVHNAKTK |
| | NNFYPREAKVQWKVDNAL | PREEQYNSTYRVVSVLTVLHQDWLNGKEYKCKVSNKAL |
| | QSGNSQESVTEQDSKDSTY | PAPIEKTISKAKGQPREPQVYTLPPSRDELTKNQVSLTCL |
| | SLSSTLTLSKADYEKHKVY | VKGFYPSDIAVEWESNGQPENNYKTTPPVLDSDGSFFLY |
| | ACEVTHQGLSSPVTKSFNR | SKLTVDKSRWQQGNVFSCSVLHEALHSHYTQKSLSLSPG |
| | GEC (SEQ ID NO: 401) | K (SEQ ID NO: 454) |
| 329.1 | MGWSCIILFLVATATGVHS | MGWSCIILFLVATATGVHSEVQLVESGGGLVQPGGSLRL |
| | EIVLTQSPATLSLSPGERAT | SCAASGFTFSSYAMSWVRQAPGKGLEWVSVISGSGGITY |
| | LSCGASQSVSSNYLAWYQ | YSDSVKGRFTISRDNSKNTLYLQMNSLRAEDTAVYYCA |
| | QKPGLAPRLLIYGASSRAT | KDWEFFWYFDLWGRGTLVTVSSAASTKGPSVFPLAPSSK |
| | GVPDRFSGSGSGTDFTLTIS | STSGGTAALGCLVKDYFPEPVTVSWNSGALTSGVHTFPA |
| | RLEPEDFAVYYCQQYGYSY | VLQSSGLYSLSSVVTVPSSSLGTQTYICNVNHKPSNTKVD |
| | TFGQGTKLEIKRTVAAPSVF | KKVEPKSCDKTHTCPPCPAPELLGGPSVFLFPPKPKDTLM |
| | IFPPSDEQLKSGTASVVCLL | ISRTPEVTCVVVDVSHEDPEVKFNWYVDGVEVHNAKTK |
| | NNFYPREAKVQWKVDNAL | PREQYNSTYRVVSVLTVLHQDWLNGKEYKCKVSNKALP |
| | QSGNSQESVTEQDSKDSTY | APIEKTISKAKGQPREPQVYTLPPSRDELTKNQVSLTCLV |
| | SLSSTLTLSKADYEKHKVY | KGFYPSDIAVEWESNGQPENNYKTTPPVLDSDGSFFLYS |
| | ACEVTHQGLSSPVTKSFNR | KLTVDKSRWQQGNVFSCSVMHEALHNHYTQKSLSLSPG |
| | GEC (SEQ ID NO: 401) | K (SEQ ID NO: 455) |
| 426.1 | MGWSCIILFLVATATGVHS | MGWSCIILFLVATATGVHSEVQLVESGGGLVQPGGSLRL |
| | EIVLTQSPATLSLSPGERAT | SCAASGFTFSSYAMSWVRQAPGKGLEWVSVISGSGGITY |
| | LSCGASQSVSSNYLAWYQ | YSDSVKGRFTISRDNSKNTLYLQMNSLRAEDTAVYYCA |
| | QKPGLAPRLLIYGASSRAT | KDWEFFWYFDLWGRGTLVTVSSAASTKGPSVFPLAPSSK |
| | GVPDRFSGSGSGTDFTLTIS | STSGGTAALGCLVKDYFPEPVTVSWNSGALTSGVHTFPA |
| | RLEPEDFAVYYCQQYGYSY | VLQSSGLYSLSSVVTVPSSSLGTQTYICNVNHKPSNTKVD |
| | TFGQGTKLEIKRTVAAPSVF | KKVEPKSCDKTHTCPPCPAPELLGGPSVFLFPPKPKDTLYI |
| | IFPPSDEQLKSGTASVVCLL | TREPEVTCVVVDVSHEDPEVKFNWYVDGVEVHNAKTKP |
| | NNFYPREAKVQWKVDNAL | REEQYNSTYRVVSVLTVLHQDWLNGKEYKCKVSNKALP |
| | QSGNSQESVTEQDSKDSTY | APIEKTISKAKGQPREPQVYTLPPSRDELTKNQVSLTCLV |
| | SLSSTLTLSKADYEKHKVY | KGFYPSDIAVEWESNGQPENNYKTTPPVLDSDGSFFLYS |
| | ACEVTHQGLSSPVTKSFNR | KLTVDKSRWQQGNVFSCSVMHEALHNHYTQKSLSLSPG |
| | GEC (SEQ ID NO: 401) | K (SEQ ID NO: 456) |
| 195.1 | MGWSCIILFLVATATGVHS | MGWSCIILFLVATATGVHSEVQLVESGGGLVQPGGSLRL |
| | EIVLTQSPATLSLSPGERAT | SCAASGFTFSSYAMSWVRQAPGKGLEWVSVISGSGGITY |
| | LSCGASQSVSSNYLAWYQ | YSDSVKGRFTISRDNSKNTLYLQMNSLRAEDTAVYYCA |
| | QKPGLAPRLLIYGASSRAT | KDWEFFWYFDLWGRGTLVTVSSASTKGPSVFPLAPSSKS |
| | GVPDRFSGSGSGTDFTLTIS | TSGGTAALGCLVKDYFPEPVTVSWNSGALTSGVHTFPAV |
| | RLEPEDFAVYYCQQYGYSY | LQSSGLYSLSSVVTVPSSSLGTQTYICNVNHKPSNTKVDK |
| | TFGQGTKLEIKRTVAAPSVF | KVEPKSCDKTHTCPPCPAPELLGGPSVFLFPPKPKDTLMIS |
| | IFPPSDEQLKSGTASVVCLL | RTPEVTCVVVDVSHEDPEVKFNWYVDGVEVHNAKTKPR |
| | NNFYPREAKVQWKVDNAL | EEQYNSTYRVVSVLTVLHQDWLNGKEYKCKVSNKALPA |
| | QSGNSQESVTEQDSKDSTY | PIEKTISKAKGQPREPQVYTLPPSRDELTKNQVSLTCLVK |
| | SLSSTLTLSKADYEKHKVY | GFYPSDIAVEWESNGQPENNYKTTPPVLDSDGSFFLYSKL |
| | ACEVTHQGLSSPVTKSFNR | TVDKSRWQQGNVFSCSVMHEALHNHYTQKSLSLSPGK |
| | GEC (SEQ ID NO: 401) | (SEQ ID NO: 457) |
| 195.2 | MGWSCIILFLVATATGVHS | MGWSCIILFLVATATGVHSEVQLVESGGGLVQPGGSLRL |
| | EIVLTQSPATLSLSPGERAT | SCAASGFTFSSYAMSWVRQAPGKGLEWVSVISGSGGITY |
| | LSCGASQSVSSNYLAWYQ | YSDSVKGRFTISRDNSKNTLYLQMNSLRAEDTAVYYCA |
| | QKPGLAPRLLIYGASSRAT | KDWEFFWYFDLWGRGTLVTVSSAKTTAPSVYPLAPVCG |
| | GVPDRFSGSGSGTDFTLTIS | DTTGSSVTLGCLVKGYFPEPVTLTWNSGSLSSGVHTFPA |
| | RLEPEDFAVYYCQQYGYSY | VLQSDLYTLSSSVTVTSSTWPSQSITCNVAHPASSTKVDK |
| | TFGQGTKLEIKRADAAPTV | KIEPRGPTIKPCPPCKCPAPNLLGGPSVFIFPPKIKDVLMIS |
| | SIFPPSSEQLTSGGASVVCFL | LSPIVTCVVVDVSEDDPDVQISWFVNNVEVHTAQTQTHR |
| | NNFYPKDINVKWKIDGSER | EDYNSTLRVVSALPIQHQDWMSGKEFKCKVNNKDLPAPI |
| | QNGVLNSWTDQDSKDSTY | ERTISKPKGSVRAPQVYVLPPPEEEMTKKQVTLTCMVTD |

TABLE 9-continued

| Antibody heavy and light chain sequences | | |
|---|---|---|
| Antibody No. | Light Chain Sequence | Heavy Chain Sequence |
| | SMSSTLTLTKDEYERHNSY<br>TCEATHKTSTSPIVKSFNRN<br>EC (SEQ ID NO: 570) | FMPEDIYVEWTNNGKTELNYKNTEPVLDSDGSYFMYSK<br>LRVEKKNWVERNSYSCSVVHEGLHNHHTTKSFSRTPGK<br>(SEQ ID NO: 458) |
| 195.4 | MGWSCIILFLVATATGVHS<br>EIVLTQSPATLSLSPGERAT<br>LSCGASQSVSSNYLAWYQ<br>QKPGLAPRLLIYGASSRAT<br>GVPDRFSGSGSGTDFTLTIS<br>RLEPEDFAVYYCQQYGYSY<br>TFGQGTKLEIKRTVAAPSVF<br>IFPPSDEQLKSGTASVVCLL<br>NNFYPREAKVQWKVDNAL<br>QSGNSQESVTEQDSKDSTY<br>SLSSTLTLSKADYEKHKVY<br>ACEVTHQGLSSPVTKSFNR<br>GEC (SEQ ID NO: 401) | MGWSCIILFLVATATGVHSEVQLVESGGGLVQPGGSLRL<br>SCAASGFTFSSYAMSWVRQAPGKGLEWVSVISGSGGITY<br>YSDSVKGRFTISRDNSKNTLYLQMNSLRAEDTAVYYCA<br>KDWEFFWYFDLWGRGTLVTVSSASTKGPSVFPLAPCSRS<br>TSESTAALGCLVKDYFPEPVTVSWNSGALTSGVHTFPAV<br>LQSSGLYSLSSVVTVPSSSLGTKTYTCNVDHKPSNTKVD<br>KRVESKYGPPCPSCPAPEFLGGPSVFLFPPKPKDTLMISRT<br>PEVTCVVVDVSQEDPEVQFNWYVDGVEVHNAKTKPREE<br>QFNSTYRVVSVLTVLHQDWLNGKEYKCKVSNKGLPSSIE<br>KTISKAKGQPREPQVYTLPPSQEEMTKNQVSLTCLVKGF<br>YPSDIAVEWESNGQPENNYKTTPPVLDSDGSFFLYSRLTV<br>DKSRWQEGNVFSCSVMHEALHNHYTQKSLSLSLGK<br>(SEQ ID NO: 459) |
| 173.1 | MGWSCIILFLVATATGVHS<br>DIQMTQSPSSLSASVGDRV<br>TITCQASQDITNYLTWYQQ<br>KPGNAPKLLIYDASNLETG<br>VPSRFSGSGSGTDFTFTINSL<br>QPEDVATYFCQQYDNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 402) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 460) |
| 267.1 | MGWSCIILFLVATATGVHS<br>DIQMTQSPSSLSASVGDRV<br>TITCQASQDITNYLTWYQQ<br>KPGNAPKLLIYDASNLETG<br>VPSRFSGSGSGTDFTFTINSL<br>QPEDVATYFCQQYDNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 402) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPEAAGGPSVFLFPPKPKDTLMIS<br>RTPEVTCVVVDVSHEDPEVKFNWYVDGVEVHNAKTKPR<br>EEQYNSTYRVVSVLTVLHQDWLNGKEYKCKVSNKALPA<br>PIEKTISKAKGQPREPQVYTLPPSRDELTKNQVSLTCLVK<br>GFYPSDIAVEWESNGQPENNYKTTPPVLDSDGSFFLYSKL<br>TVDKSRWQQGNVFSCSVMHEALHNHYTQKSLSLSPGK<br>(SEQ ID NO: 461) |
| 102.1 | MGWSCIILFLVATATGVHS<br>DIQMTQSPSSLSASVGDRV<br>TITCQASQDITNYLTWYQQ<br>KPGNAPKLLIYDASNLETG<br>VPSRFSGSGSGTDFTFTINSL<br>QPEDVATYFCQQYDNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 402) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYASTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 462) |
| 420.1 | MGWSCIILFLVATATGVHS<br>DIQMTQSPSSLSASVGDRV<br>TITCQASQDITNYLTWYQQ<br>KPGNAPKLLIYDASNLETG<br>VPSRFSGSGSGTDFTFTINSL<br>QPEDVATYFCQQYDNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 402) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLYITR<br>EPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 463) |

TABLE 9-continued

Antibody heavy and light chain sequences

| Antibody No. | Light Chain Sequence | Heavy Chain Sequence |
| --- | --- | --- |
| 289.1 | MGWSCIILFLVATATGVHS<br>DIQMTQSPSSLSASVGDRV<br>TITCQASQDITNYLTWYQQ<br>KPGNAPKLLIYDASNLETG<br>VPSRFSGSGSGTDFTFTINSL<br>QPEDVATYFCQQYDNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 402) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVLHEALHSHYTQKSLSLSPGK<br>(SEQ ID NO: 464) |
| 374.1 | MGWSCIILFLVATATGVHS<br>DIQMTQSPSSLSASVGDRV<br>TITCQASQHITNYLTWYQQ<br>KPGNAPKLLIYDASNLETG<br>VPSRFSGSGSGTDFTFTINSL<br>QPEDVATYFCQQYDNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 403) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 460) |
| 394.1 | MGWSCIILFLVATATGVHS<br>DIQMTQSPSSLSASVGDRV<br>TITCQASQDITNYLTWYQQ<br>KPGNAPKLLIYHASNLETG<br>VPSRFSGSGSGTDFTFTINSL<br>QPEDVATYFCQQYDNLPTF<br>GGGTKVEIKRTVAAPSVFI<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 404) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 460) |
| 213.1 | MGWSCIILFLVATATGVHS<br>DIQMTQSPSSLSASVGDRV<br>TITCQASQDITNYLTWYQQ<br>KPGNAPKLLIYDASNLETG<br>VPSRFSGSGSGTDFTFTINSL<br>QPEDVATYFCQQYHNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 405) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 460) |
| 219.1 | MGWSCIILFLVATATGVHS<br>DIQMTQSPSSLSASVGDRV<br>TITCQASQDITNYLTWYQQ<br>KPGNAPKLLIYDASNLHTG<br>VPSRFSGSGSGTDFTFTINSL<br>QPEDVATYFCQQYDNLPTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 406) | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSAASTKGPSVFPLAPSSKSTS<br>GGTAALGCLVKDYFPEPVTVSWNSGALTSGVHTFPAVL<br>QSSGLYSLSSVVTVPSSSLGTQTYICNVNHKPSNTKVDKK<br>VEPKSCDKTHTCPPCPAPELLGGPSVFLFPPKPKDTLMISR<br>TPEVTCVVVDVSHEDPEVKFNWYVDGVEVHNAKTKPRE<br>EQYNSTYRVVSVLTVLHQDWLNGKEYKCKVSNKALPAP<br>IEKTISKAKGQPREPQVYTLPPSRDELTKNQVSLTCLVKG<br>FYPSDIAVEWESNGQPENNYKTTPPVLDSDGSFFLYSKLT<br>VDKSRWQQGNVFSCSVMHEALHNHYTQKSLSLSPGK<br>(SEQ ID NO: 460) |
| 410.1 | MGWSCIILFLVATATGVHS<br>DIQMTQSPSSLSASVGDRV<br>TITCQASQDITNYLTWYQQ<br>KPGNAPKLLIYDASNLETG<br>VPSRFSGSGSGTDFTFTINSL | MGWSCIILFLVATATGVHSQLQLQESGPGLVKPSETLSLT<br>CIVSGGSISSSGYYWGWIRQPPGKGLEWIGSIFYSGNTHY<br>NPSLKSRVTIPVDTSKNQFSLKLSSVTAADSAVYYCARR<br>DILTGPFDYWGQGTLVTVSSASTKGPSVFPLAPSSKSTSG<br>GTAALGCLVKDYFPEPVTVSWNSGALTSGVHTFPAVLQS |

TABLE 9-continued

Antibody heavy and light chain sequences

| Antibody No. | Light Chain Sequence | Heavy Chain Sequence |
|---|---|---|
| | QPEDVATYFCQQYDNLPTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 402) | SGLYSLSSVVTVPSSSLGTQTYICNVNHKPSNTKVDKKVE PKSCDKTHTCPPCPAPELLGGPSVFLFPPKPKDTLMISRTP EVTCVVVDVSHEDPEVKFNWYVDGVEVHNAKTKPREE QYNSTYRVVSVLTVLHQDWLNGKEYKCKVSNKALPAPI EKTISKAKGQPREPQVYTLPPSRDELTKNQVSLTCLVKGF YPSDIAVEWESNGQPENNYKTTPPVLDSDGSFFLYSKLTV DKSRWQQGNVFSCSVMHEALHNHYTQKSLSLSPGK (SEQ ID NO: 465) |
| 380.1 | MGWSCIILFLVATATGVHS DIQMTQSPSSLSASVGDRV TITCQASQDITNYLTWYQQ KPGNAPKLLIYDASNLETG VPSRFSGSGSGTDFTFTINSL QPEDVATYFCQQYDNLPTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 402) | MGWSCIILFLVATATGVHSQLQLQESGPGLVKPSETLSLT CIVSGGSISSSGYYWGWIRQPPGKGLEWIGSIFYSGNTHY NPSLKSRVTIPVDTSKNQFSLKLSSVTAADSAVYYCARR DILTGPFDYWGQGTLVTVSSAASTKGPSVFPLAPSSKSTS GGTAALGCLVKDYFPEPVTVSWNSGALTSGVHTFPAVL QSSGLYSLSSVVTVPSSSLGTQTYICNVNHKPSNTKVDKK VEPKSCDKTHTCPPCPAPELLGGPSVFLFPPKPKDTLMISR TPEVTCVVVDVSHEDPEVKFNWYVDGVEVHNAKTKPRE QYNSTYRVVSVLTVLHQDWLNGKEYKCKVSNKALPAPI EKTISKAKGQPREPQVYTLPPSRDELTKNQVSLTCLVKGF YPSDIAVEWESNGQPENNYKTTPPVLDSDGSFFLYSKLTV DKSRWQQGNVFSCSVMHEALHNHYTQKSLSLSPGK (SEQ ID NO: 466) |
| 410.2 | MGWSCIILFLVATATGVHS DIQMTQSPSSLSASVGDRV TITCQASQDITNYLTWYQQ KPGNAPKLLIYDASNLETG VPSRFSGSGSGTDFTFTINSL QPEDVATYFCQQYDNLPTF GGGTKVEIKRADAAPTVSIF PPSSEQLTSGGASVVCFLNN FYPKDINVKWKIDGSERQN GVLNSWTDQDSKDSTYSM SSTLTLTKDEYERHNSYTC EATHKTSTSPIVKSFNRNEC (SEQ ID NO: 571) | MGWSCIILFLVATATGVHSQLQLQESGPGLVKPSETLSLT CIVSGGSISSSGYYWGWIRQPPGKGLEWIGSIFYSGNTHY NPSLKSRVTIPVDTSKNQFSLKLSSVTAADSAVYYCARR DILTGPFDYWGQGTLVTVSSAKTTAPSVYPLAPVCGDTT GSSVTLGCLVKGYFPEPVTLTWNSGSLSSGVHTFPAVLQ SDLYTLSSSVTVTSSTWPSQSITCNVAHPASSTKVDKKIEP RGPTIKPCPPCKCPAPNLLGGPSVFIFPPKIKDVLMISLSPI VTCVVVDVSEDDPDVQISWFVNNVEVHTAQTQTHREDY NSTLRVVSALPIQHQDWMSGKEFKCKVNNKDLPAPIERT ISKPKGSVRAPQVYVLPPPEEEMTKKQVTLTCMVTDFMP EDIYVEWTNNGKTELNYKNTEPVLDSDGSYFMYSKLRV EKKNWVERNSYSCSVVHEGLHNHHTTKSFSRTPGK (SEQ ID NO: 467) |
| 173.4 | MGWSCIILFLVATATGVHS DIQMTQSPSSLSASVGDRV TITCQASQDITNYLTWYQQ KPGNAPKLLIYDASNLETG VPSRFSGSGSGTDFTFTINSL QPEDVATYFCQQYDNLPTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 402) | MGWSCIILFLVATATGVHSQLQLQESGPGLVKPSETLSLT CIVSGGSISSSGYYWGWIRQPPGKGLEWIGSIFYSGNTHY NPSLKSRVTIPVDTSKNQFSLKLSSVTAADSAVYYCARR DILTGPFDYWGQGTLVTVSSAASTKGPSVFPLAPCSRSTS ESTAALGCLVKDYFPEPVTVSWNSGALTSGVHTFPAVLQ SSGLYSLSSVVTVPSSSLGTKTYTCNVDHKPSNTKVDKR VESKYGPPCPSCPAPEFLGGPSVFLFPPKPKDTLMISRTPE VTCVVVDVSQEDPEVQFNWYVDGVEVHNAKTKPREEQ FNSTYRVVSVLTVLHQDWLNGKEYKCKVSNKGLPSSIEK TISKAKGQPREPQVYTLPPSQEEMTKNQVSLTCLVKGFY PSDIAVEWESNGQPENNYKTTPPVLDSDGSFFLYSRLTVD KSRWQEGNVFSCSVMHEALHNHYTQKSLSLSLGK (SEQ ID NO: 468) |
| 380.4 | MGWSCIILFLVATATGVHS DIQMTQSPSSLSASVGDRV TITCQASQDITNYLTWYQQ KPGNAPKLLIYDASNLETG VPSRFSGSGSGTDFTFTINSL QPEDVATYFCQQYDNLPTF GGGTKVEIKRTVAAPSVFIF PPSDEQLKSGTASVVCLLN NFYPREAKVQWKVDNALQ SGNSQESVTEQDSKDSTYS LSSTLTLSKADYEKHKVYA CEVTHQGLSSPVTKSFNRG EC (SEQ ID NO: 402) | MGWSCIILFLVATATGVHSQLQLQESGPGLVKPSETLSLT CIVSGGSISSSGYYWGWIRQPPGKGLEWIGSIFYSGNTHY NPSLKSRVTIPVDTSKNQFSLKLSSVTAADSAVYYCARR DILTGPFDYWGQGTLVTVSSAASTKGPSVFPLAPCSRSTS ESTAALGCLVKDYFPEPVTVSWNSGALTSGVHTFPAVLQ SSGLYSLSSVVTVPSSSLGTKTYTCNVDHKPSNTKVDKR VESKYGPPCPSCPAPEFLGGPSVFLFPPKPKDTLMISRTPE VTCVVVDVSQEDPEVQFNWYVDGVEVHNAKTKPREQF NSTYRVVSVLTVLHQDWLNGKEYKCKVSNKGLPSSIEKT ISKAKGQPREPQVYTLPPSQEEMTKNQVSLTCLVKGFYPS DIAVEWESNGQPENNYKTTPPVLDSDGSFFLYSRLTVDK SRWQEGNVFSCSVMHEALHNHYTQKSLSLSLGK (SEQ ID NO: 469) |
| 420.4 | MGWSCIILFLVATATGVHS DIQMTQSPSSLSASVGDRV TITCQASQDITNYLTWYQQ KPGNAPKLLIYDASNLETG VPSRFSGSGSGTDFTFTINSL QPEDVATYFCQQYDNLPTF GGGTKVEIKRTVAAPSVFIF PPSDEQLKSGTASVVCLLN NFYPREAKVQWKVDNALQ SGNSQESVTEQDSKDSTYS | MGWSCIILFLVATATGVHSQLQLQESGPGLVKPSETLSLT CIVSGGSISSSGYYWGWIRQPPGKGLEWIGSIFYSGNTHY NPSLKSRVTIPVDTSKNQFSLKLSSVTAADSAVYYCARR DILTGPFDYWGQGTLVTVSSAASTKGPSVFPLAPCSRSTS ESTAALGCLVKDYFPEPVTVSWNSGALTSGVHTFPAVLQ SSGLYSLSSVVTVPSSSLGTKTYTCNVDHKPSNTKVDKR VESKYGPPCPSCPAPEFLGGPSVFLFPPKPKDTLYITREPE VTCVVVDVSQEDPEVQFNWYVDGVEVHNAKTKPREEQ FNSTYRVVSVLTVLHQDWLNGKEYKCKVSNKGLPSSIEK TISKAKGQPREPQVYTLPPSQEEMTKNQVSLTCLVKGFY |

TABLE 9-continued

Antibody heavy and light chain sequences

| Antibody No. | Light Chain Sequence | Heavy Chain Sequence |
|---|---|---|
| | LSSTLTLSKADYEKHKVYACEVTHQGLSSPVTKSFNRGEC (SEQ ID NO: 402) | PSDIAVEWESNGQPENNYKTTPPVLDSDGSFFLYSRLTVDKSRWQEGNVFSCSVMHEALHNHYTQKSLSLSLGK (SEQ ID NO: 470) |
| 371.4 | MGWSCIILFLVATATGVHSDIQMTQSPSSLSASVGDRVTITCQASQDITNYLTWYQQKPGNAPKLLIYDASNLETGVPSRFSGSGSGTDFTFTINSLQPEDVATYFCQQYDNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 402) | MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK (SEQ ID NO: 471) |
| 289.4 | MGWSCIILFLVATATGVHSDIQMTQSPSSLSASVGDRVTITCQASQDITNYLTWYQQKPGNAPKLLIYDASNLETGVPSRFSGSGSGTDFTFTINSLQPEDVATYFCQQYDNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 402) | MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLGK (SEQ ID NO: 472) |
| 410.4 | MGWSCIILFLVATATGVHSDIQMTQSPSSLSASVGDRVTITCQASQDITNYLTWYQQKPGNAPKLLIYDASNLETGVPSRFSGSGSGTDFTFTINSLQPEDVATYFCQQYDNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 402) | MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK (SEQ ID NO: 473) |
| 833.1 | MGWSCIILFLVATATGVHSEIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 387) | MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 474) |
| 982.1 | MGWSCIILFLVATATGVHSEIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 387) | MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 475) |

TABLE 9-continued

Antibody heavy and light chain sequences

| Antibody No. | Light Chain Sequence | Heavy Chain Sequence |
|---|---|---|
| 982.2 | MGWSCIILFLVATATGVHS<br>EIVLTQSPDFQSVTPKEKVT<br>ITCRASQSIGSSLHWYQQKP<br>DQSPKLLIKYASQSISGVPS<br>RFSGSGSGTDFTLTINSLEA<br>EDAAAYYCHQSSSLPQTFG<br>QGTKVEIKRADAAPTVSIFP<br>PSSEQLTSGGASVVCFLNNF<br>YPKDINVKWKIDGSERQNG<br>VLNSWTDQDSKDSTYSMSS<br>TLTLTKDEYERHNSYTCEA<br>THKTSTSPIVKSFNRNEC<br>(SEQ ID NO: 388) | MGWSCIILFLVATATGVHSQVQLVESGGGVVQPGRSLRL<br>SCAASGFTFSSYGMHWVRQAPGKGLEWVADIWYDGSN<br>KHYADSVKGRFTISRDNSKNTLYLQMNSLRAEDTAVYY<br>CARESDDERPYFYYGMDVWGQGTTVTVSSAKTTAPSVY<br>PLAPVCGDTTGSSVTLGCLVKGYFPEPVTLTWNSGSLSS<br>GVHTFPAVLQSDLYTLSSSVTVTSSTWPSQSITCNVAHPA<br>SSTKVDKKIEPRGPTIKPCPPCKCPAPNLLGGPSVFIFPPKI<br>KDVLMISLSPIVTCVVVDVSEDDPDVQISWFVNNVEVHT<br>AQTQTHREDYNSTLRVVSALPIQHQDWMSGKEFKCKVN<br>NKDLPAPIERTISKPKGSVRAPQVYVLPPPEEEMTKKQVT<br>LTCMVTDFMPEDIYVEWTNNGKTELNYKNTEPVLDSDG<br>SYFMYSKLRVEKKNWVERNSYSCSVVHEGLHNHHTTKS<br>FSRTPGK (SEQ ID NO: 476) |
| 982.4 | MGWSCIILFLVATATGVHS<br>EIVLTQSPDFQSVTPKEKVT<br>ITCRASQSIGSSLHWYQQKP<br>DQSPKLLIKYASQSISGVPS<br>RFSGSGSGTDFTLTINSLEA<br>EDAAAYYCHQSSSLPQTFG<br>QGTKVEIKRTVAAPSVFIFP<br>PSDEQLKSGTASVVCLLNN<br>FYPREAKVQWKVDNALQS<br>GNSQESVTEQDSKDSTYSL<br>SSTLTLSKADYEKHKVYAC<br>EVTHQGLSSPVTKSFNRGE<br>C (SEQ ID NO: 387) | MGWSCIILFLVATATGVHSQVQLVESGGGVVQPGRSLRL<br>SCAASGFTFSSYGMHWVRQAPGKGLEWVADIWYDGSN<br>KHYADSVKGRFTISRDNSKNTLYLQMNSLRAEDTAVYY<br>CARESDDERPYFYYGMDVWGQGTTVTVSSASTKGPSVF<br>PLAPCSRSTSESTAALGCLVKDYFPEPVTVSWNSGALTSG<br>VHTFPAVLQSSGLYSLSSVVTVPSSSLGTKTYTCNVDHKP<br>SNTKVDKRVESKYGPPCPSCPAPEFLGGPSVFLFPPKPKD<br>TLMISRTPEVTCVVVDVSQEDPEVQFNWYVDGVEVHNA<br>KTKPREEQFNSTYRVVSVLTVLHQDWLNGKEYKCKVSN<br>KGLPSSIEKTISKAKGQPREPQVYTLPPSQEEMTKNQVSL<br>TCLVKGFYPSDIAVEWESNGQPENNYKTTPPVLDSDGSF<br>FLYSRLTVDKSRWQEGNVFSCSVMHEALHNHYTQKSLS<br>LSLGK (SEQ ID NO: 477) |
| 150.1 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLYITREPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 573) |
| 246.4 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 391) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPCSRSTSESTAA<br>LGCLVKDYFPEPVTVSWNSGALTSGVHTFPAVLQSSGLY<br>SLSSVVTVPSSSLGTKTYTCNVDHKPSNTKVDKRVESKY<br>GPPCPPCPAPEFLGGPSVFLFPPKPKDTLMISRTPEVTCVV<br>VDVSQEDPEVQFNWYVDGVEVHNAKTKPREEQFNSTYR<br>VVSVLTVLHQDWLNGKEYKCKVSNKGLPSSIEKTISKAK<br>GQPREPQVYTLPPSQEEMTKNQVSLTCLVKGFYPSDIAV<br>EWESNGQPENNYKTTPPVLDSDGSFFLYSRLTVDKSRWQ<br>EGNVFSCSVMHEALHNHYTQKSLSLSLGK (SEQ ID NO:<br>574) |
| 80 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLPF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 598) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 604) |
| 83 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE | MGWSCIILFLVATATGVHSQVQLQESGPGLVKPSETLSLT<br>CTVSGGSVSSYYWSWIRQPPGKGLEWIGYIYYSGSTNYN<br>PSLKSRVTISVDTSKSQFSLKLGSVTAADTAGYYCARDIP<br>AFAFEIWGQGTMVIVSSASTKGPSVFPLAPSSKSTSGGTA<br>ALGCLVKDYFPEPVTVSWNSGALTSGVHTFPAVLQSSGL |

TABLE 9-continued

Antibody heavy and light chain sequences

| Antibody No. | Light Chain Sequence | Heavy Chain Sequence |
| --- | --- | --- |
| | PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 599) | YSLSSVVTVPSSSLGTQTYICNVNHKPSNTKVDKKVEPKS<br>CDKTHTCPPCPAPELLGGPSVFLFPPKPKDTLMISRTPEVT<br>CVVVDVSHEDPEVKFNWYVDGVEVHNAKTKPREEQYN<br>STYRVVSVLTVLHQDWLNGKEYKCKVSNKALPAPIEKTI<br>SKAKGQPREPQVYTLPPSRDELTKNQVSLTCLVKGFYPS<br>DIAVEWESNGQPENNYKTTPPVLDSDGSFFLYSKLTVDK<br>SRWQQGNVFSCSVMHEALHNHYTQKSLSLSPGK (SEQ<br>ID NO: 605) |
| 85 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 600) | MGWSCIILFLVATATGVHSQVQLQESGPGLVKPSETLSLT<br>CTVSGGSISSYYWSWIRKPPGKGLEWIGYIYYSGSTNYNP<br>SLKSRVTISVDTSKSQFSLKLSSVTAADTAVYYCARDIPA<br>FALDIWGQGTMVTVSSASTKGPSVFPLAPSSKSTSGGTA<br>ALGCLVKDYFPEPVTVSWNSGALTSGVHTFPAVLQSSGL<br>YSLSSVVTVPSSSLGTQTYICNVNHKPSNTKVDKKVEPKS<br>CDKTHTCPPCPAPELLGGPSVFLFPPKPKDTLMISRTPEVT<br>CVVVDVSHEDPEVKFNWYVDGVEVHNAKTKPREEQYN<br>STYRVVSVLTVLHQDWLNGKEYKCKVSNKALPAPIEKTI<br>SKAKGQPREPQVYTLPPSRDELTKNQVSLTCLVKGFYPS<br>DIAVEWESNGQPENNYKTTPPVLDSDGSFFLYSKLTVDK<br>SRWQQGNVFSCSVMHEALHNHYTQKSLSLSPGK (SEQ<br>ID NO: 606) |
| 87 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 601) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>SAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 607) |
| 91 | MGWSCIILFLVATATGVHS<br>EIVLTQSPATLSLSPGERAT<br>LSCRASQSVSYYLAWYQQ<br>KPGQAPRLLIYDAFNRATGI<br>PARFSGSGSGTDFTLTISSLE<br>PEDFAVYYCQQRINWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 602) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCASDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 608) |
| 92 | MGWSCIILFLVATATGVHS<br>EIVLTQSPATLSLSPGERAT<br>LSCRASQSVNYYLAWYQQ<br>KPGQAPRLLIYDAFNRATGI<br>PARFSGSGSGTDFTLTISSLE<br>PEDFAVYYCQQRISWPLTF<br>GGGTKVEIKRTVAAPSVFIF<br>PPSDEQLKSGTASVVCLLN<br>NFYPREAKVQWKVDNALQ<br>SGNSQESVTEQDSKDSTYS<br>LSSTLTLSKADYEKHKVYA<br>CEVTHQGLSSPVTKSFNRG<br>EC (SEQ ID NO: 603) | MGWSCIILFLVATATGVHSQVQLQESGPGLVKPSETLSLT<br>CTVSGGSISSYYWSWIRQPPGKGLEWIGYIYYSGSTNYNP<br>SLKSRVTISVDTSKSQFSLKLSSVTAADTAVYYCARDIPA<br>FAFDIWGQGTMVIVSSASTKGPSVFPLAPSSKSTSGGTAA<br>LGCLVKDYFPEPVTVSWNSGALTSGVHTFPAVLQSSGLY<br>SLSSVVTVPSSSLGTQTYICNVNHKPSNTKVDKKVEPKSC<br>DKTHTCPPCPAPELLGGPSVFLFPPKPKDTLMISRTPEVTC<br>VVVDVSHEDPEVKFNWYVDGVEVHNAKTKPREEQYNS<br>TYRVVSVLTVLHQDWLNGKEYKCKVSNKALPAPIEKTIS<br>KAKGQPREPQVYTLPPSRDELTKNQVSLTCLVKGFYPSDI<br>AVEWESNGQPENNYKTTPPVLDSDGSFFLYSKLTVDKSR<br>WQQGNVFSCSVMHEALHNHYTQKSLSLSPGK (SEQ ID<br>NO: 609) |

In specific aspects, provided herein is an antibody or an antigen-binding fragment thereof that specifically binds to VISTA comprising an antibody heavy chain and/or light chain, e.g., a heavy chain alone, a light chain alone, or both a heavy chain and a light chain. With respect to the light chain, in specific embodiments, the light chain of an antibody or an antigen-binding fragment thereof that specifically binds to VISTA described herein is a kappa light chain. In another specific embodiment, the light chain of an antibody or an antigen-binding fragment thereof that specifically binds to VISTA described herein is a lambda light chain. In yet another specific embodiment, the light chain of an antibody or an antigen-binding fragment thereof that specifically binds to VISTA described herein is a human kappa light chain or a human lambda light chain.

As used herein, the terms "constant region" or "constant domain" are interchangeable and have their meaning common in the art. The constant region is an antibody portion, e.g., a carboxyl terminal portion of a light and/or heavy chain which is not directly involved in binding of an antibody to antigen but which can exhibit various effector functions, such as, for example, interaction with the Fc receptor in the case of the heavy chain. The constant region of an immunoglobulin molecule has a more conserved amino acid sequence relative to an immunoglobulin variable domain.

In a specific embodiment, an antibody or an antigen-binding fragment thereof that specifically binds to VISTA described herein comprises a light chain, wherein the light chain comprises a VL and a human kappa or lambda light chain constant region, wherein the VL comprises a sequence set forth in Table 8. Non-limiting examples of human constant region sequences have been described in the art, e.g., see Kabat E A et al., (1991).

With respect to the heavy chain, in a specific embodiment, the heavy chain of an antibody or an antigen-binding fragment thereof that specifically binds to VISTA described herein can be a human alpha (α), delta (δ), epsilon (ε), gamma (γ) or mu (μ) heavy chain. In a specific embodiment, an antibody or an antigen-binding fragment thereof that specifically binds to VISTA comprises a heavy chain, wherein the heavy chain comprises the constant region or a portion thereof (e.g. $C_H1$, $C_H2$ or $C_H3$ or a combination thereof) described herein or known in the art, and a variable heavy chain region (VH), wherein the VH comprises a sequence set forth in Table 7. In a specific embodiment, the constant region is of a human gamma heavy chain.

In a specific embodiment, an antibody or an antigen-binding fragment thereof that specifically binds to VISTA described herein comprises a heavy chain variable region (VH) and a light chain variable region (VL) comprising any amino acid sequences described herein, and wherein the constant regions comprise the amino acid sequences of the constant regions of a human IgG, IgE, IgM, IgD, IgA, IgW or IgY immunoglobulin molecule. In specific embodiments, an antibody or antigen-binding fragment that specifically binds to VISTA comprises an IgG constant region, e.g. an $IgG_1$, $IgG_2$ or $IgG_4$ constant region set forth in Table 10. In a specific embodiment, an antibody or an antigen-binding fragment thereof that specifically binds to VISTA described herein comprises the constant regions of a human IgG, IgE, IgM, IgD, IgA IgW, or IgY immunoglobulin molecule, of any class (e.g., $IgG_1$, $IgG_2$, $IgG_3$, $IgG_4$, $IgA_1$ and $IgA_2$), or any subclass (e.g., $IgG_{2a}$ and $IgG_{2b}$) of immunoglobulin molecule.

TABLE 10

Exemplary Constant Regions

| Description | Sequence |
|---|---|
| Light Chain Constant Region (kappa) (UniProt No. P01834) (human) | RTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVT KSFNRGEC (SEQ ID NO: 361) |
| Light Chain Constant Region (kappa) (UniProt No. P01837) (mouse) | RADAAPTVSIFPPSSEQLTSGGASVVCFLNNFYPKDINVKWKIDGSERQN GVLNSWTDQDSKDSTYSMSSTLTLTKDEYERHNSYTCEATHKTSTSPIVK SFNRNEC (SEQ ID NO: 362) |
| IgG1 Heavy Chain Constant Region (UniProt No. P01857) (human) | ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLN GKEYKCKVSNKALPAPIEKTISKAKGQPREPQVYTLPPSRDELTKNQVSL TCLVKGFYPSDIAVEWESNGQPENNYKTTPPVLDSDGSFFLYSKLTVDKS RWQQGNVFSCSVMHEALHNHYTQKSLSLSPGK (SEQ ID NO: 363) |
| IgG4 Heavy Chain Constant Region (UniProt No. P01861) (human) | ASTKGPSVFPLAPCSRSTSESTAALGCLVKDYFPEPVTVSWNSGALTSGV HTFPAVLQSSGLYSLSSVVTVPSSSLGTKTYTCNVDHKPSNTKVDKRVES KYGPPCPSCPAPEFLGGPSVFLFPPKPKDTLMISRTPEVTCVVVDVSQEDP EVQFNWYVDGVEVHNAKTKPREEQFNSTYRVVSVLTVLHQDWLNGKE YKCKVSNKGLPSSIEKTISKAKGQPREPQVYTLPPSQEEMTKNQVSLTCL VKGFYPSDIAVEWESNGQPENNYKTTPPVLDSDGSFFLYSRLTVDKSRW QEGNVFSCSVMHEALHNHYTQKSLSLSLGK (SEQ ID NO: 364) |
| IgG2a Heavy Chain Constant (UniProt No. P01863) (mouse) | AKTTAPSVYPLAPVCGDTTGSSVTLGCLVKGYFPEPVTLTWNSGSLSSGV HTFPAVLQSDLYTLSSSVTVTSSTWPSQSITCNVAHPASSTKVDKKIEPRG PTIKPCPPCKCPAPNLLGGPSVFIFPPKIKDVLMISLSPIVTCVVVDVSEDDP DVQISWFVNNVEVHTAQTQTHREDYNSTLRVVSALPIQHQDWMSGKEF KCKVNNKDLPAPIERTISKPKGSVRAPQVYVLPPPEEEMTKKQVTLTCMV TDFMPEDIYVEWTNNGKTELNYKNTEPVLDSDGSYFMYSKLRVEKKNW VERNSYSCSVVHEGLHNHHTTKSFSRTPGK (SEQ ID NO: 365) |

TABLE 10-continued

Exemplary Constant Regions

| Description | Sequence |
|---|---|
| IgG1 Heavy Chain Constant LALA (L234A and L235A substitutions according to EU numbering) (human) | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPEAAGGPSVFLFPPKPKDTLMISRTPEVTCVVVDVSH<br>EDPEVKFNWYVDGVEVHNAKTKPREEQYNSTYRVVSVLTVLHQDWLN<br>GKEYKCKVSNKALPAPIEKTISKAKGQPREPQVYTLPPSRDELTKNQVSL<br>TCLVKGFYPSDIAVEWESNGQPENNYKTTPPVLDSDGSFFLYSKLTVDKS<br>RWQQGNVFSCSVMHEALHNHYTQKSLSLSPGK (SEQ ID NO: 366) |
| IgG1 Heavy Chain Constant N297 (substitution of N in position 297 according to EU numbering) (human) | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSH<br>EDPEVKFNWYVDGVEVHNAKTKPREEQYASTYRVVSVLTVLHQDWLN<br>GKEYKCKVSNKALPAPIEKTISKAKGQPREPQVYTLPPSRDELTKNQVSL<br>TCLVKGFYPSDIAVEWESNGQPENNYKTTPPVLDSDGSFFLYSKLTVDKS<br>RWQQGNVFSCSVMHEALHNHYTQKSLSLSPGK (SEQ ID NO: 367) |
| IgG1 Heavy Chain Constant E294del (deletion of amino acid no. 294 according to EU numbering) (human) | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSH<br>EDPEVKFNWYVDGVEVHNAKTKPRE_QYNSTYRVVSVLTVLHQDWLNG<br>KEYKCKVSNKALPAPIEKTISKAKGQPREPQVYTLPPSRDELTKNQVSLTC<br>LVKGFYPSDIAVEWESNGQPENNYKTTPPVLDSDGSFFLYSKLTVDKSRW<br>QQGNVFSCSVMHEALHNHYTQKSLSLSPGK (SEQ ID NO: 368) |
| IgG1 Heavy Chain Constant YTE (M252Y, S254T, and T256E substitutions according to EU numbering) (human) | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLYITREPEVTCVVVDVSH<br>EDPEVKFNWYVDGVEVHNAKTKPREEQYNSTYRVVSVLTVLHQDWLN<br>GKEYKCKVSNKALPAPIEKTISKAKGQPREPQVYTLPPSRDELTKNQVSL<br>TCLVKGFYPSDIAVEWESNGQPENNYKTTPPVLDSDGSFFLYSKLTVDKS<br>RWQQGNVFSCSVMHEALHNHYTQKSLSLSPGK (SEQ ID NO: 369) |
| IgG1 Heavy Chain Constant LS (M428L and N434S substitutions according to EU numbering) (human) | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSH<br>EDPEVKFNWYVDGVEVHNAKTKPREEQYNSTYRVVSVLTVLHQDWLN<br>GKEYKCKVSNKALPAPIEKTISKAKGQPREPQVYTLPPSRDELTKNQVSL<br>TCLVKGFYPSDIAVEWESNGQPENNYKTTPPVLDSDGSFFLYSKLTVDKS<br>RWQQGNVFSCSVLHEALHSHYTQKSLSLSPGK (SEQ ID NO: 370) |
| IgG4 Heavy Chain Constant E294del (deletion of amino acid no. 294 according to EU numbering) (human) | ASTKGPSVFPLAPCSRSTSESTAALGCLVKDYFPEPVTVSWNSGALTSGV<br>HTFPAVLQSSGLYSLSSVVTVPSSSLGTKTYTCNVDHKPSNTKVDKRVES<br>KYGPPCPSCPAPEFLGGPSVFLFPPKPKDTLMISRTPEVTCVVVDVSQEDP<br>EVQFNWYVDGVEVHNAKTKPRE_QFNSTYRVVSVLTVLHQDWLNGKEY<br>KCKVSNKGLPSSIEKTISKAKGQPREPQVYTLPPSQEEMTKNQVSLTCLV<br>KGFYPSDIAVEWESNGQPENNYKTTPPVLDSDGSFFLYSRLTVDKSRWQE<br>GNVFSCSVMHEALHNHYTQKSLSLSLGK (SEQ ID NO: 371) |
| IgG4 Heavy Chain Constant YTE (M252Y, S254T, and T256E substitutions according to EU numbering) (human) | ASTKGPSVFPLAPCSRSTSESTAALGCLVKDYFPEPVTVSWNSGALTSGV<br>HTFPAVLQSSGLYSLSSVVTVPSSSLGTKTYTCNVDHKPSNTKVDKRVES<br>KYGPPCPSCPAPEFLGGPSVFLFPPKPKDTLYITREPEVTCVVVDVSQEDP<br>EVQFNWYVDGVEVHNAKTKPREEQFNSTYRVVSVLTVLHQDWLNGKE<br>YKCKVSNKGLPSSIEKTISKAKGQPREPQVYTLPPSQEEMTKNQVSLTCL<br>VKGFYPSDIAVEWESNGQPENNYKTTPPVLDSDGSFFLYSRLTVDKSRW<br>QEGNVFSCSVMHEALHNHYTQKSLSLSLGK (SEQ ID NO: 372) |
| IgG4 Heavy Chain Constant LS (M428L and N434S substitutions according to EU numbering) (human) | ASTKGPSVFPLAPCSRSTSESTAALGCLVKDYFPEPVTVSWNSGALTSGV<br>HTFPAVLQSSGLYSLSSVVTVPSSSLGTKTYTCNVDHKPSNTKVDKRVES<br>KYGPPCPSCPAPEFLGGPSVFLFPPKPKDTLMISRTPEVTCVVVDVSQEDP<br>EVQFNWYVDGVEVHNAKTKPREEQFNSTYRVVSVLTVLHQDWLNGKE<br>YKCKVSNKGLPSSIEKTISKAKGQPREPQVYTLPPSQEEMTKNQVSLTCL<br>VKGFYPSDIAVEWESNGQPENNYKTTPPVLDSDGSFFLYSRLTVDKSRW<br>QEGNVFSCSVLHEALHSHYTQKSLSLSLGK (SEQ ID NO: 373) |
| IgG2a Heavy Chain Constant LALA (L234A and L235A substitutions according to EU numbering) (mouse) | AKTTAPSVYPLAPVCGDTTGSSVTLGCLVKGYFPEPVTLTWNSGSLSSGV<br>HTFPAVLQSDLYTLSSSVTVTSSTWPSQSITCNVAHPASSTKVDKKIEPRG<br>PTIKPCPPCKCPAPNAAGGPSVFIFPPKIKDVLMISLSPIVTCVVVDVSEDD<br>PDVQISWFVNNVEVHTAQTQTHREDYNSTLRVVSALPIQHQDWMSGKEF<br>KCKVNNKDLPAPIERTISKPKGSVRAPQVYVLPPPEEEMTKKQVTLTCMV<br>TDFMPEDIYVEWTNNGKTELNYKNTEPVLDSDGSYFMYSKLRVEKKNW<br>VERNSYSCSVVHEGLHNHHTTKSFSRTPGK (SEQ ID NO: 374) |
| IgG4 Heavy Chain S228P (S228P substitution according to EU numbering) | ASTKGPSVFPLAPCSRSTSESTAALGCLVKDYFPEPVTVSWNSGALTSGV<br>HTFPAVLQSSGLYSLSSVVTVPSSSLGTKTYTCNVDHKPSNTKVDKRVES<br>KYGPPCPPCPAPEFLGGPSVFLFPPKPKDTLMISRTPEVTCVVVDVSQEDP<br>EVQFNWYVDGVEVHNAKTKPREEQFNSTYRVVSVLTVLHQDWLNGKE |

TABLE 10-continued

| Exemplary Constant Regions | |
|---|---|
| Description | Sequence |
| (human) | YKCKVSNKGLPSSIEKTISKAKGQPREPQVYTLPPSQEEMTKNQVSLTCL VKGFYPSDIAVEWESNGQPENNYKTTPPVLDSDGSFFLYSRLTVDKSRW QEGNVFSCSVMHEALHNHYTQKSLSLSLGK (SEQ ID NO: 375) |
| IgG2 Heavy Chain Constant (UniProt No. P01859) (human) | ASTKGPSVFPLAPCSRSTSESTAALGCLVKDYFPEPVTVSWNSGALTSGV HTFPAVLQSSGLYSLSSVVTVPSSNFGTQTYTCNVDHKPSNTKVDKTVER KCCVECPPCPAPPVAGPSVFLFPPKPKDTLMISRTPEVTCVVVDVSHEDPE VQFNWYVDGVEVHNAKTKPREEQFNSTFRVVSVLTVVHQDWLNGKEY KCKVSNKGLPAPIEKTISKTKGQPREPQVYTLPPSREEMTKNQVSLTCLV KGFYPSDISVEWESNGQPENNYKTTPPMLDSDGSFFLYSKLTVDKSRWQ QGNVFSCSVMHEALHNHYTQKSLSLSPGK (SEQ ID NO: 376) |

In a particular embodiment, an antibody or an antigen-binding fragment thereof that specifically binds to VISTA described herein comprises a heavy chain and/or a light chain, wherein the heavy chain comprises (a) the VH of an antibody set forth in Table 7 and (b) a constant heavy chain domain comprising the amino acid sequence of the constant domain of a human IgG.

In another particular embodiment, an antibody or an antigen-binding fragment thereof that specifically binds to VISTA described herein comprises a heavy chain and a light chain, wherein (i) the heavy chain comprises (a) the VH of an antibody set forth in Table 7 and (b) a constant heavy chain domain comprising the amino acid sequence of the constant domain of a human IgG; and (ii) the light chain comprises the VL of the same antibody set forth in Table 8, and (b) a constant light chain domain comprising the amino acid sequence of the constant domain of a human kappa light chain.

Fc Regions and Variant Fc Regions

In a specific embodiment, an antibody described herein comprises an Fc region. In a specific embodiment, an antibody described herein comprises an Fc region of human $IgG_1$. In a specific embodiment, the Fc region is a human Fc region. In a further specific embodiment, the human Fc region is of human $IgG_1$ or human $IgG_2$ or human $IgG_4$. In a further specific embodiment, the Fc region is a variant human Fc region that comprises one or more mutations (e.g., one, two, three, four or five amino acid mutations) in the Fc region relative to a native human Fc region. In a specific embodiment, the one or more mutations are insertions, substitutions, and/or deletions.

In a specific embodiment, an antibody or antigen-binding fragment thereof that specifically binds to VISTA has in its constant region only one of the specific amino acid mutations or specific combinations of amino acid mutations, relative to wild-type constant region, specified in this disclosure and does not contain other amino acid mutations relative to wild-type constant region. In another specific embodiment, an antibody or antigen-binding fragment thereof that specifically binds to VISTA comprises in its constant region a specific amino acid mutation or specific combination of amino acid mutations, relative to wild-type constant region, specified in this disclosure, and has no more than a total of seven (i.e., one, two, three, four, five, six, or seven) amino acid mutations relative to wild-type constant region.

Thus, in a specific embodiment wherein the Fc region comprises one, two, three, four, or five amino acid mutations in the Fc region relative to a native human Fc region, the mutations are independently selected from the group consisting of a deletion of one amino acid, a substitution of one amino acid, or an insertion of one amino acid, and in a specific embodiment can be any of the mutations described herein.

In specific embodiments, an antibody that specifically binds to VISTA provided herein comprises a heavy chain constant region of the $IgG_1$, $IgG_2$, $IgG_3$ or $IgG_4$ isotype/class. In specific embodiments, an antibody that specifically binds to VISTA provided herein comprises a human Fe region of the $IgG_1$, $IgG_2$, $IgG_3$ or $IgG_4$ isotype/class. In particular embodiments, the constant region of an antibody or antigen-binding fragment provided herein that specifically binds VISTA comprises one, two, three, four or five amino acid mutations relative to the native constant region. In specific embodiments of the anti-VISTA antibodies and antigen-binding fragments of the invention, the antibody comprises an Fc region or a variant of the Fc region; optionally wherein the Fc region is a human Fc region or a variant of the human Fc region that has one, two, three, four or five amino acid mutations in the Fc region relative to the native human Fe region, and/or optionally wherein the human Fe region is of a human $IgG_1$, human $IgG_2$ or a human $IgG_4$, further optionally wherein the antibody comprises a constant region of a human $IgG_1$ or a human $IgG_4$ or a variant of the constant region that has one, two, three, four or five amino acid mutations in the constant region relative to the native constant region.

In certain embodiments, one, two or more mutations (e.g., amino acid substitutions) are introduced into the Fe region of an antibody or an antigen-binding fragment thereof that specifically binds to VISTA described herein to alter one or more functional properties of the antibody.

In specific embodiments, one, two or more mutations (e.g., amino acid substitutions) are introduced into the Fc region and/or the hinge region of an antibody or an antigen-binding fragment thereof that specifically binds to VISTA described herein. Mutations in the Fc region of an antibody or an antigen-binding fragment thereof that specifically binds to VISTA may modify the affinity of the antibody for an Fc receptor and/or complement receptors. Techniques for introducing such mutations into the Fc receptor or fragment thereof are known to one of skill in the art. Examples of mutations in the Fc receptor of an antibody or an antigen-binding fragment thereof that specifically binds to VISTA that can be made to alter the affinity of the antibody or an antigen-binding fragment thereof for an Fe receptor are described in, e.g., Smith P et al., (2012) Proc. Natl. Acad. Sci 109: 6181-6186, U.S. Pat. No. 6,737,056, and International Publication Nos. WO 02/060919; WO 98/23289; and WO 97/34631.

In certain embodiments, an antibody provided herein comprises a constant region set forth in Table 10. Without wishing to be bound by theory, the constant region of antibodies contributes to the sequence variation of the heavy chain. The variable region of the heavy chain recombines with the heavy chain constant region to produce a full-length heavy chain (Dreyer, W. J., and J. C. Bennett Proc. Natl. Acad. Sci. USA 54 (1965) 864-869). The antibody can vary in isotype depending on whether the alpha, mu, gamma, epsilon, or delta constant region gene segment is recombined with the variable region (Kataoka, T., et. Al. Proc. Natl. Acad. Sci. USA 77 (1980) 919-923). Among the human gamma gene segments there are 4 different subclasses designated as gamma 1, 2, 3, and 4, which are approximately 90% identical to each other. Any of these different isotypes or subclasses may be joined to a variable region of an antibody described herein to produce a full-length heavy chain, which can then be paired with a complementary light chain to produce an antibody of the invention.

For antibody engineering of the antibodies provided herein, changes to the sequence and/or post-translational modification of the Fe and hinge regions of antibodies allows one to manipulate the effector functions and circulation of a given antibody or antibody-like protein (Presta, L. G. Curr. Opin. Immunol. 20 (2008) 460-470). In addition to sequence variation, the Fe region also contains an N-linked glycosylation site at residue 297 (EU numbering system), which is important for Fc structure and function (Dwek, R. R. et al. J. Anat. 187 (1995) 279-292), and which can be mutated e.g., to an alanine or glycine or glutamic acid, to destroy the glycosylation site in order to affect properties of the antibody.

The glycan present at N297 typically consists of two N-acetylglucosamine (GlcNAc), three mannose, and two more GlcNAc linked to the mannose to form a biantennary complex glycan (Liu, L. J. Pharm Sci. 104 (2015) 1866-84). The two GlcNAc are linked to mannose through either a β1,2 linkage to α-3 or α-6 of the mannose. Thus, each arm of the glycan can be distinguished as the α1,3 or α1,6 arm depending upon how the mannose and GlcNAc2 are linked (Liu, L. J. Pharm Sci. 104 (2015) 1866-84). Additional fucose, galactose, sialic acid, and GlcNAc can be added to the core glycan structure, and the glycan composition has direct effects on FcγR binding.

For example, expression of β(1,4)-N-acetylglucosaminyltransferase III when expressing IgG gives an antibody glycosylated at N297 that has a biantennary glycan and has better ADCC activity (Umana, P. et. Al. Nat. Biotech. 17 (1999) 176-180). Antibodies with reduced fucose content have been reported to have an increased affinity for Fc receptors, such as, e.g., FcγRIIIa. Antibodies deficient in fucose have been shown to have 50-fold higher binding to FcγRIIIa and enhanced ADCC activity (Shields, R. L., et. Al. J. Biol. Chem. 277 (2002) 26733-26740). Galactosylation of N297 enhances C1q binding and CDC activity (Dekkers, G., et. Al. Front. Immunol. 8 (2017) 877). Any of these manipulations of N297 glycosylation can be carried out for the antibodies of the invention.

In specific embodiments, an antibody described herein mediates ADCC, ADCP, and/or CDC. Mutations in the Fc region of antibodies may enhance effector functions such as, for example, antibody-dependent cytotoxicity (ADCC), antibody-dependent cellular phagocytosis (ADCP), complement-dependent cytotoxicity (CDC) (Saunders, K. O. Front. Immunol. 10 (2019) 1-20).

Certain combinations of mutations increase affinity for FcγRIIIa, FcγRIIa and/or FcγRIa and enhance ADCC and/or ADCP, and can be present in the anti-VISTA antibodies and antigen-binding fragments provided herein. Examples of combinations of mutations that increase affinity for FcγRIIIa and/or FcγRIIa and enhance ADCC and/or ADCP which can be present in the anti-VISTA antibodies and antigen-binding fragments provided herein include any of (1) the combination of S298A, E333A and K334A; (2) the combination of S239D, A330L and 1332E; (3) the combination of S239D and 1332E; (4) the combination of G236A, S239D, A330L, and 1332E; (5) the combination of S239D, 1332E, and G236A; and (6) the combination of L234Y, G236W and S298A; wherein the residues are numbered using the EU numbering system. The "EU numbering system," also termed the "EU Index" (i.e., the EU index reported in Kabat et al., 1991, National Institutes of Health (U.S.) Office of the Director, *Sequences of Proteins of Immunological Interest* (5th ed., DIANE Publishing: Collingdale, PA1991) is generally used when referring to a residue in an immunoglobulin heavy chain constant region.

Certain mutations or combinations of mutations increase C1q binding and CDC, and can be present in the anti-VISTA antibodies and antigen-binding fragments provided herein. Examples of mutations or combinations of mutations that increase C1q binding and CDC, which can be present in the anti-VISTA antibodies and antigen-binding fragments provided herein, include any of (1) the combination of K326A and E333A (2) the combination of K326M and E333S; (3) the combination of C221D and D222C; (4) the combination of S267E, H268F and S324T; (5) the combination of H268F and S324T; and (6) E345R; wherein the residues are numbered using the EU numbering system.

In vivo IgG catabolism is regulated by the interaction of IgG with the neonatal Fc receptor (FcRn) (Sockolosky J. T., et. Al. Adv. Drug Deliv. Rev. 91 (2015) 109-124). IgG is endocytosed by cells where it can be shuttled to lysosomes or recycled back to the cell surface (Roopenian, D. C., and Akilesh, S. Nat. Rev. Immunol. 7 (2007) 715-725). Binding of IgG to FcRn at low pH (pH<6.5) in the endosomes allows the antibody to be trafficked with the FcRn back to the cell surface. Poor binding to FcRn at pH<6.5 results in the antibody being trafficked to the lysosome and degraded. At the physiologic pH of the extracellular environment, IgG has weak affinity for FcRn which results in its release from the FcRn back into circulation. Therefore, mutations which can be present in the anti-VISTA antibodies and antigen-binding fragments provided herein may increase FcRn binding at pH<6.5 and thus increase antibody recycling and improve PK.

Examples of mutations and combinations of mutations increasing FcRn binding and therefore antibody half-life, which can be present in the anti-VISTA antibodies and antigen-binding fragments provided herein, include any of (1) R435H; (2) N434A; (3) the combination of M252Y, S254T and T256E; (4) the combination of M428L and N434S; (5) the combination of E294deletion, T307P and N434Y; (6) the combination of T256N, A378V, S383N and N434Y; and (7) the deletion of E294, wherein the residues are numbered using the EU numbering system.

Mutations that reduce Fc receptor binding, complement receptor binding or antibody effector functions also may be desirable and may be present in the anti-VISTA antibodies and antigen-binding fragments provided herein. Such mutations may reduce inflammation and cell killing mediated by an antibody or antigen-binding fragment. Examples of mutations and combinations of mutations that decrease binding to FcγRI, FcγRII, FcγRIII and/or C1q, thereby reducing ADCC, ADCP and/or CDC, which can be present in the anti-VISTA antibodies and antigen-binding fragments provided herein, include any of (1) L235E; (2) the combination of L234A and L235A; (3) the combination of S228P and L235E (this combination termed the SPLE mutation in which the S228P mutation avoids a class switch to IgG4; see Schlothauer et al. Protein Eng Des Sel (2016) 29:457-466); (4) the combination of L234A, L235A and P329G; (5) the combination of P331S, L234E and L235F; (6) D265A; (7) G237A; (8) E318A; (9) E233P; (10) the combination of G236R and L328R; (11) the combination of H268Q, V309L, A330S and P331S; (12) the combination of L234A, L235A, G237A, P238S, H268A, A330S and P331S; (13) any one, two, three, four, five, or six of L234A, L235A, G237A, P238S, H268A, A330S and P331S; (14) A330L; (15) D270A; (16) K322A; (17) P329A; (18) P331A; (19) V264A; (20) F241A; N297A; N297G; N297E; and (21) the combination of S228P, F234A and L235A; wherein the residues are numbered using the EU numbering system.

In specific embodiments, an antibody that specifically binds to VISTA provided herein comprises a variant of a human Fc region, wherein the human Fc region is of a human IgG1, wherein the Fe region has one or more amino acid mutations, e.g., one, two, three, four, five, six, or seven amino acid mutations, in the Fc region relative to the native human Fc region, selected from the group consisting of C220D, D221C, E233P, L234A, L234E, L234Y, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, E318A, K322A, S324T, K326A, K326M, L328R, P329A, P329G, A330L, A330S, P331A, P331S, 1332E, E333A, E333S, K334A, A378V, S383N, M428L, N434S, and N434Y, wherein the residues are numbered using the EU numbering system.

In specific embodiments, an antibody that specifically binds to VISTA provided herein comprises a variant of a human Fc region, wherein the human Fe region is of a human IgG2, wherein the Fe region has one or more amino acid mutations, e.g., one, two, three, four, five, six or seven amino acid mutations, in the Fc region relative to the native human Fc region, selected from the group consisting of C220D, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, A330L, A330S, P331A, P331S, 1332E, E333A, E333S, K334A, S383N, M428L, N434S, and N434Y, wherein the residues are numbered using the EU numbering system.

In specific embodiments, an antibody that specifically binds to VISTA provided herein comprises a variant of a human Fc region, wherein the human Fc region is of a human IgG4, wherein the Fc region has one or more amino acid mutations, e.g., one, two, three, four, five, six or seven amino acid mutations, in the Fe region relative to the native human Fc region, selected from the group consisting of S228P, E233P, F234A, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, 1332E, E333A, E333S, K334A, A378V, S383N, M428L, N434S, and N434Y, wherein the residues are numbered using the EU numbering system.

In specific embodiments, an antibody that specifically binds to VISTA provided herein comprises a variant of a human Fe region, wherein the human Fe region is of a human IgG1, wherein the Fc region has one or more amino acid mutations relative to the native human Fc region, and wherein the mutations are L234A and L235A, and optionally P329G, wherein the residues are numbered using the EU numbering system. In specific embodiments, an antibody that specifically binds to VISTA provided herein comprises a variant of a human Fc region, wherein the human Fe region is of a human IgG1, wherein the Fc region has one or more amino acid mutations relative to the native human Fe region, and wherein the mutations are F234A and L235A, and optionally P329G, wherein the residues are numbered using the EU numbering system.

In specific embodiments, an antibody that specifically binds to VISTA provided herein comprises a variant of a human Fc region, wherein the human Fc region is of a human IgG1, IgG2, or IgG4, wherein the Fc region has one or more amino acid mutations relative to the native human Fc region, and wherein the mutations are M252Y, S254T, and T256E, wherein the residues are numbered using the EU numbering system.

In specific embodiments, an antibody that specifically binds to VISTA provided herein comprises a variant of a human Fc region, wherein the human Fc region is of a human IgG1, IgG2, or IgG4, wherein the Fc region has one or more amino acid mutations relative to the native human Fc region, and wherein the mutations are M428L and N434S, wherein the residues are numbered using the EU numbering system.

In specific embodiments, an antibody that specifically binds to VISTA provided herein a variant of a human Fc region, wherein the human Fc region is of a human IgG4, wherein the Fc region has one or more amino acid mutations relative to the native human Fc region, and wherein the mutations are S228P and L235E, wherein the residues are numbered using the EU numbering system.

In specific embodiments, an antibody that specifically binds to VISTA provided herein comprises a variant of a human Fc region, wherein the human Fe region is of a human IgG4, wherein the Fc region has one or more amino acid mutations relative to the native human Fc region, and wherein the mutations are S228P, M252Y, S254T, and T256E, wherein the residues are numbered using the EU numbering system.

In specific embodiments, an antibody that specifically binds to VISTA provided herein comprises a variant of a human Fc region, wherein the human Fc region is of a human IgG4, wherein the Fc region has one or more amino acid mutations relative to the native human Fc region, and wherein the mutations are S228P, M428L and N434S, wherein the residues are numbered using the EU numbering system.

In specific embodiments, an antibody that specifically binds to VISTA provided herein comprises a variant of a human Fc region, wherein the human Fe region is of a human IgG1, wherein the Fc region has in the range of 1-10 amino acid mutations relative to the native human Fc region, and wherein the mutations comprise L234A and L235A, and optionally P329G, wherein the residues are numbered using the EU numbering system. In specific embodiments, an antibody that specifically binds to VISTA provided herein comprises a variant of a human Fc region, wherein the human Fc region is of a human IgG1, wherein the Fc region has in the range of 1-10 amino acid mutations relative to the native human Fc region, and wherein the mutations comprise F234A and L235A, and optionally P329G, wherein the residues are numbered using the EU numbering system.

In specific embodiments, an antibody that specifically binds to VISTA provided herein comprises a variant of a human Fc region, wherein the human Fc region is of a human IgG1, IgG2, or IgG4, wherein the Fc region has in the range of 1-10 amino acid mutations relative to the native human Fc region, and wherein the mutations comprise M252Y, S254T, and T256E, wherein the residues are numbered using the EU numbering system.

In specific embodiments, an antibody that specifically binds to VISTA provided herein comprises a variant of a human Fc region, wherein the human Fc region is of a human IgG1, IgG2, or IgG4, wherein the Fc region has in the range of 1-10 amino acid mutations relative to the native human Fc region, and wherein the mutations comprise mutations M428L and N434S, wherein the residues are numbered using the EU numbering system.

In specific embodiments, an antibody that specifically binds to VISTA provided herein a variant of a human Fc region, wherein the human Fc region is of a human IgG4, wherein the Fc region has in the range of 1-10 amino acid mutations relative to the native human Fc region, and wherein the mutations comprise S228P and L235E, wherein the residues are numbered using the EU numbering system.

In specific embodiments, an antibody that specifically binds to VISTA provided herein comprises a variant of a human Fc region, wherein the human Fc region is of a human IgG4, wherein the Fc region has in the range of 1-10 amino acid mutations relative to the native human Fc region, and wherein the mutations comprise S228P, M252Y, S254T, and T256E, wherein the residues are numbered using the EU numbering system.

In specific embodiments, an antibody that specifically binds to VISTA provided herein comprises a variant of a human Fc region, wherein the human Fc region is of a human IgG4, wherein the Fe region has in the range of 1-10 amino acid mutations relative to the native human Fc region, and wherein the mutations comprise S228P, M428L and N434S, wherein the residues are numbered using the EU numbering system.

In specific embodiments, an antibody that specifically binds to VISTA described herein comprises a glycosylated constant region. In specific embodiments, an antibody comprises a non-glycosylated constant region. Accordingly, in certain embodiments, an antibody that specifically binds to VISTA described herein have reduced fucose content or no fucose content.

In specific embodiments, an antibody that specifically binds to VISTA provided herein is a mixed isotype antibody, i.e., an antibody containing a heavy chain constant region derived from two or more different isotypes.

In specific embodiments, an antibody that specifically binds to VISTA provided herein comprises a biantennary glycan ($GlcNAc_2Man_3GlcNAc_2$) attached to Asn 297 (as determined by EU numbering system) of the IgG-Fc of the antibody. In specific embodiments, an antibody that specifically binds to VISTA provided herein is a deglycosylated antibody, an afucosylated antibody, or a galactosylated antibody.

In specific embodiments, an antibody that specifically binds to VISTA provided herein and that comprises one or more amino acid mutations described herein reduces target mediated drug disposition, e.g., receptor-mediated endocytosis followed by lysosomal degradation, compared to the antibody which does not comprise said one or more amino acid substitutions.

In specific embodiments, an antibody that specifically binds to VISTA provided herein exhibits pH-dependent binding to VISTA.

In specific embodiments, an antibody or an antigen-binding fragment thereof that specifically binds to VISTA provided herein comprises any of the histidine mutations described in the preceding paragraphs in combination with any mutation to the constant region described including mutations that increase or decrease binding to Fc receptors or C1q receptors. In specific embodiments, an antibody or an antigen-binding fragment thereof that specifically binds to VISTA provided herein comprises histidine substitutions that enhance target dissociation at acidic pH and mutations that enhance FcRn binding.

Binding Characteristics

In specific embodiments, an antibody or an antigen-binding fragment thereof that specifically binds to VISTA binds to human VISTA (e.g., expressed from a nucleic acid encoding SEQ ID NO: 377); in particular, mature human VISTA lacking the signal sequence. Mature human VISTA is amino acids 33-311 of SEQ ID NO:377, which lacks the signal sequence that is amino acids 1-32 of SEQ ID NO:377. In specific embodiments, an antibody or an antigen-binding fragment thereof that specifically binds to VISTA binds to the extracellular domain (ECD) of human VISTA (e.g., amino acids 33-194 of SEQ ID NO: 378). In specific embodiments, an antibody or an antigen-binding fragment thereof that specifically binds to VISTA binds to both human VISTA and cynomolgus monkey VISTA (e.g., mature monkey VISTA expressed from a nucleic acid encoding SEQ ID NO: 380 or otherwise lacking the signal sequence). In specific embodiments, an antibody or an antigen-binding fragment thereof that specifically binds to VISTA does not bind to mouse VISTA (e.g., mature mouse VISTA expressed from a nucleic acid encoding SEQ ID NO: 369 or otherwise lacking the signal sequence). Exemplary sequences of VISTA are set forth in Table 11 below, with the signal sequences underlined and in bold.

TABLE 11

Exemplary VISTA Sequences

| Description | Sequence |
|---|---|
| human VISTA (bold underline: signal sequence) | **MGVPTALEAGSWRWGSLLFALFLAASLGPVAA**FKVATPYSLYVCPEG QNVTLTCRLLGPVDKGHDVTFYKTWYRSSRGEVQTCSERRPIRNLTFQD LHLHHGGHQAANTSHDLAQRHGLESASDHHGNFSITMRNLTLLDSGLYC CLVVEIRHHHSEHRVHGAMELQVQTGKDAPSNCVVYPSSSQDSENITAA ALATGACIVGILCLPLILLLVYKQRQAASNRRAQELVRMDSNIQGIENPGF EASPPAQGIPEAKVRHPLSYVAQRQPSESGRHLLSEPSTPLSPPGPGDVFFP SLDPVPDSPNFEVI (SEQ ID NO: 377) |

TABLE 11-continued

| Exemplary VISTA Sequences | |
|---|---|
| Description | Sequence |
| Human VISTA ECD (bold underline: signal sequence) | **MGVPTALEAGSWRWGSLLFALFLAASLGPVAA**FKVATPYSLYVCPEG<br>QNVTLTCRLLGPVDKGHDVTFYKTWYRSSRGEVQTCSERRPIRNLTFQD<br>LHLHHGGHQAANTSHDLAQRHGLESASDHHGNFSITMRNLTLLDSGLYC<br>CLVVEIRHHHSEHRVHGAMELQVQTGKDAPSNCVVYPSSSQDSENITAA<br>(SEQ ID NO: 378) |
| Mouse VISTA (bold underline: signal sequence) | **MGVPAVPEASSPRWGTLLLAIFLAASRGLVAA**FKVTTPYSLYVCPEGQ<br>NATLTCRILGPVSKGHDVTIYKTWYLSSRGEVQMCKEHRPIRNFTLQHLQ<br>HHGSHLKANASHDQPQKHGLELASDHHGNFSITLRNVTPRDSGLYCCLVI<br>ELKNHHPEQRFYGSMELQVQAGKGSGSTCMASNEQDSDSITAAALATGA<br>CIVGILCLPLILLLVYKQRQVASHRRAQELVRMDSNTQGIENPGFETTPPF<br>QGMPEAKTRPPLSYVAQRQPSESGRYLLSDPSTPLSPPGPGDVFFPSLDPV<br>PDSPNSEAI (SEQ ID NO: 379) |
| Cynomolgus monkey VISTA (bold underline: signal sequence) | **MGVPTAPEAGCWRWGSLLFALFLAASLGPVAA**FKVATLYSLYVCPEG<br>QNVTLTCRVFGPVDKGHDVTFYKTWYRSSRGEVQTCSERRPIRNLTFQD<br>LHLHHGGHQAANTSHDLAQRHGLESASDHHGNFSITMRNLTLLDSGLYC<br>CLVVEIRHHHSEHRVHGAMELQVQTGKDAPSSCVAYPSSSQESENITAAA<br>LATGACIVGILCLPLILLLVYKQRQAASNRRAQELVRMDSNTQGIENPGFE<br>ASSPAQGILEAKVRHPLSYVAQRQPSESGRHLLSEPGTPLSPPGPGDVFFPS<br>LDPVPDSPNFEVI (SEQ ID NO: 380) |
| human VISTA-Fc (bold underline: signal sequence) | **MGVPTALEAGSWRWGSLLFALFLAASLGPVAA**FKVATPYSLYVCPEG<br>QNVTLTCRLLGPVDKGHDVTFYKTWYRSSRGEVQTCSERRPIRNLTFQD<br>LHLHHGGHQAANTSHDLAQRHGLESASDHHGNFSITMRNLTLLDSGLYC<br>CLVVEIRHHHSEHRVHGAMELQVQTGKDAPSNCVVYPSSSQDSENITAAI<br>EGRMDPKSCDKTHTCPPCPAPELLGGPSVFLFPPKPKDTLMISRTPEVTCV<br>VVDVSHEDPEVKFNWYVDGVEVHNAKTKPREEQYNSTYRVVSVLTVLH<br>QDWLNGKEYKCKVSNKALPAPIEKTISKAKGQPREPQVYTLPPSRDELTK<br>NQVSLTCLVKGFYPSDIAVEWESNGQPENNYKTTPPVLDSDGSFFLYSKL<br>TVDKSRWQQGNVFSCSVMHEALHNHYTQKSLSLSPGK (SEQ ID NO: 381) |
| human VISTA-Fc 54A62A63A (substitutions at positions 54, 62 and 63, numbered from the first amino acid after the signal sequence) (bold underline: signal sequence) | **MGVPTALEAGSWRWGSLLFALFLAASLGPVAA**FKVATPYSLYVCPEG<br>QNVTLTCRLLGPVDKGHDVTFYKTWYRSSRGEVQTCSEARPIRNLTAAD<br>LHLHHGGHQAANTSHDLAQRHGLESASDHHGNFSITMRNLTLLDSGLYC<br>CLVVEIRHHHSEHRVHGAMELQVQTGKDAPSNCVVYPSSSQDSENITAAI<br>EGRMDPKSCDKTHTCPPCPAPELLGGPSVFLFPPKPKDTLMISRTPEVTCV<br>VVDVSHEDPEVKFNWYVDGVEVHNAKTKPREEQYNSTYRVVSVLTVLH<br>QDWLNGKEYKCKVSNKALPAPIEKTISKAKGQPREPQVYTLPPSRDELTK<br>NQVSLTCLVKGFYPSDIAVEWESNGQPENNYKTTPPVLDSDGSFFLYSKL<br>TVDKSRWQQGNVFSCSVMHEALHNHYTQKSLSLSPGK (SEQ ID NO: 382) |

In certain embodiments, an antibody or an antigen-binding fragment thereof that specifically binds to VISTA binds to the ECD of human VISTA with a $K_D$ of about 0.5 nM to about 1 nM, about 1 nM to about 1.5 nM, about 1.5 nM to about 2 nM, about 2 nM to about 2.5 nM, about 2.5 nM to about 3 nM, about 3 nM to about 5 nM, about 5 nM to about 10 nM, about 10 nM to about 20 nM, or about 20 nM to about 100 nM as determined by biolayer interferometry.

In specific embodiments, an antibody or an antigen-binding fragment thereof that specifically binds to VISTA binds to the ECD of cynomolgus monkey VISTA with a $K_D$ of about 0.5 nM to about 1 nM, about 1 nM to about 1.5 nM, about 1.5 nM to about 2 nM, about 2 nM to about 2.5 nM, about 2.5 nM to about 3 nM, about 3 nM to about 5 nM, about 5 nM to about 10 nM, about 10 nM to about 20 nM, or about 20 nM to about 100 nM as determined by biolayer interferometry.

Affinity can be measured and/or expressed in a number of ways known in the art, including, but not limited to, equilibrium dissociation constant ($K_D$), and equilibrium association constant ($K_A$). The $K_D$, can be determined by techniques known to one of ordinary skill in the art, such as, for example, biolayer interferometry or surface plasmon resonance, e.g., the methods described below.

In specific embodiments, an antibody or an antigen-binding fragment thereof that specifically binds to VISTA binds to human VISTA with a half-effective concentration ($EC_{50}$) of about 0.5 nM, about 0.9 nM, about 1.6 nM, about 1.7 nM, about 2.1 nM, about 2.7 nM, about 3.2 nM, about 4.2 nM, about 5.5 nM, or about 11.7 nM as measured by ELISA.

In specific embodiments, an antibody or an antigen-binding fragment thereof that specifically binds to VISTA binds to human VISTA on the surface of cells with an $EC_{50}$ of about 0.05 nM, about 0.06 nM, about 0.09 nM, about 0.1 nM, about 0.2 nM, about 0.3 nM, about 0.4 nM, about 0.6 nM, about 0.8 nM or about 1.2 nM.

In specific embodiments, an antibody or an antigen-binding fragment thereof that specifically binds to VISTA does not bind to B7-1 (also known as CD80), B7-2 (also known as CD86), B7-H2 (also known as ICOS ligand), B7-H1 (also known as PD-LI or CD274), B7-DC (also known as PD-L2 or CD273), B7-H4 (also known as B7S1), and/or B7-H3 (also known as CD276).

In specific embodiments, an antibody or an antigen-binding fragment thereof that specifically binds to VISTA blocks the interaction between V-set and Ig domain-containing protein 3 (VSIG3) and VISTA. In specific embodiments, an antibody or an antigen-binding fragment thereof that specifically binds to VISTA blocks VISTA dimerization or another homotypic interaction. In specific embodiments, an antibody or an antigen-binding fragment thereof that specifically binds to VISTA blocks the interaction between P-selectin glycoprotein ligand 1 (PSGL1) and VISTA. In specific embodiments, an antibody or an antigen-binding fragment thereof that specifically binds to VISTA blocks the interaction between V-set Ig domain-containing protein 8 (VSIG 8) and VISTA. In specific embodiments, an antibody or an antigen-binding fragment thereof that specifically binds to VISTA blocks the interaction between Leucine-rich repeats and immunoglobulin-like domains protein 1 (LRIG1) and VISTA.

In specific embodiments, an antibody or an antigen-binding fragment thereof that specifically binds to VISTA binds an epitope of VISTA containing the sequence $_{66}$HLHHG$_{70}$ (amino acids 98-102 of SEQ ID NO:377) or $_{116}$VVEIIRHHHSEHR$_{127}$(amino acids 148-159 of SEQ ID NO: 377) (wherein the numbering of the VISTA residues begins with the first amino acid after the signal peptide). The signal sequence of VISTA is bold and underlined in Table 11. In one embodiment, the antibody, or antigen-binding fragment thereof, binds to an epitope of human VISTA comprising Tyrosine 37, Arginine 54, Valine 117 and Arginine 127 of SEQ ID NO:377.

In specific embodiments, provided herein are antibodies and antigen-binding fragments thereof that bind the same or an overlapping epitope of VISTA as an antibody described herein. As used herein, an "epitope" is a term used according to its meaning known in the art and refers to a localized region of an antigen to which an antibody can specifically bind via its antigen-binding domain. An epitope can be, for example, contiguous amino acids of a polypeptide (linear or contiguous epitope) or an epitope can, for example, come together from two or more non-contiguous regions of a polypeptide or polypeptides (conformational, non-linear, discontinuous, or non-contiguous epitope).

An antibody or antigen-binding fragment thereof that binds the same or an overlapping epitope of VISTA as an antibody described herein may be a human antibody, a humanized antibody, a chimeric antibody, or a bispecific antibody. Humanized antibodies generally comprise human constant regions and variable regions comprising human framework regions, but the CDRs are of a non-human species (e.g., murine CDRs). Chimeric antibodies generally comprise human-derived constant regions and variable regions of a non-human species (e.g., murine variable regions).

In certain embodiments, the epitope of an antibody can be determined by, e.g., NMR spectroscopy, X-ray diffraction crystallography study, ELISA assay, hydrogen/deuterium exchange coupled with mass spectrometry (e.g., MALDI mass spectrometry), array-based oligo-peptide scanning assays, and/or mutagenesis mapping (e.g., site-directed mutagenesis mapping), or by a method described below. For X-ray crystallography, crystallization may be accomplished using any of the known methods in the art (e.g., Giegé R et al., (1994) Acta Crystallogr D Biol Crystallogr 50(Pt 4): 339-350; McPherson A (1990) Eur J Biochem 189: 1-23; Chayen N E (1997) Structure 5: 1269-1274; McPherson A (1976) J Biol Chem 251: 6300-6303). Antibody:antigen crystals may be studied using well known X-ray diffraction techniques and may be refined using computer software such as, for example, X-PLOR (Yale University, 1992, distributed by Molecular Simulations, Inc.; see e.g. Meth Enzymol (1985) volumes 114 & 115, eds Wyckoff H W et al.,; U.S. Patent Application No. 2004/0014194), and BUSTER (Bricogne G (1993) Acta Crystallogr D Biol Crystallogr 49(Pt 1): 37-60; Bricogne G (1997) Meth Enzymol 276A: 361-423, ed Carter C W; Roversi P et al., (2000) Acta Crystallogr D Biol Crystallogr 56(Pt 10): 1316-1323). Mutagenesis mapping studies may be accomplished using any method known to one of skill in the art. See, e.g., Champe M et al., (1995) and Cunningham B C & Wells J A (1989) for a description of mutagenesis techniques, including alanine scanning mutagenesis techniques.

Antibodies that recognize and bind to the same or overlapping epitopes of VISTA as the antibodies described herein can also be identified using a routine technique such as, for example, an immunoassay, for example, by showing the ability of one antibody to block the binding of another antibody to a target antigen, i.e., a competitive binding assay. A competition binding assays also can be used to determine whether two antibodies have similar binding specificity for an epitope. Competitive binding can be determined in an assay in which the immunoglobulin under test inhibits specific binding of a reference antibody to a common antigen, such as, for example, VISTA. Numerous types of competitive binding assays are known, for example: solid phase direct or indirect radioimmunoassay (RIA), solid phase direct or indirect enzyme immunoassay (EIA), sandwich competition assay (see Stahli C et al., (1983) Methods Enzymol 9: 242-253); solid phase direct biotin-avidin EIA (see Kirkland T N et al., (1986) J Immunol 137: 3614-9); solid phase direct labeled assay, solid phase direct labeled sandwich assay (see Harlow E & Lane D, (1988) Antibodies: A Laboratory Manual, Cold Spring Harbor Press); solid phase direct label RIA using I-125 label (see Morel G A et al., (1988) Mol Immunol 25(1): 7-15); solid phase direct biotin-avidin EIA (Cheung R C et al., (1990) Virology 176: 546-52); direct labeled RIA. (Moldenhauer G et al., (1990) Scand J Immunol 32: 77-82); and by biolayer interferometry ("BLI"), e.g., BLI on the Octet Red 96 (ForteBio) system. Typically, such an assay involves the use of purified antigen (e.g., VISTA) bound to a solid surface or cells bearing either of these, an unlabeled test immunoglobulin and a labeled reference immunoglobulin. Competitive inhibition can be measured by determining the amount of label bound to the solid surface or cells in the presence of the test immunoglobulin. Usually, the test immunoglobulin is present in excess. Usually, when a competing antibody is present in excess, it will inhibit specific binding of a reference antibody to a common antigen by at least 50-55%, 55-60%, 60-65%, 65-70% 70-75% or more. A competition binding assay can be configured in a large number of different formats using either labeled antigen or labeled antibody. In a common version of this assay, the antigen is immobilized on a 96-well plate. The ability of unlabeled antibodies to block the binding of labeled antibodies to the antigen is then measured using radioactive or enzyme labels. For further details see, for example, Wagener C et al., (1983) J Immunol 130: 2308-2315; Wagener C et al., (1984) J Immunol Methods 68: 269-274; Kuroki M et al., (1990) Cancer Res 50: 4872-4879; Kuroki M et al., (1992) Immunol Invest 21: 523-538; Kuroki M et al., (1992) Hybridoma 11: 391-407 and Antibodies: A Laboratory Manual, Ed Harlow E & Lane D editors supra, pp. 386-389.

In certain aspects, a competition binding assay can be used to determine whether an antibody is competitively blocked, e.g., in a dose dependent manner, by another antibody. In a specific embodiment, the competition binding assay is a competitive ELISA, which can be configured in a number of different formats, using either labeled antigen or labeled antibody. In a particular embodiment, an antibody can be tested in a competition binding assay with an antibody described herein.

In a specific embodiment, provided herein are antibodies that compete (e.g., in a dose dependent manner) for binding to VISTA with an antibody or an antigen-binding fragment thereof that specifically binds to VISTA described herein as determined using any of assays known to one of skill in the art or described herein, for example, ELISA competitive assays, BLI (e.g., BLI on the Octet Red 96 (ForteBio) system, or surface plasmon resonance). In a specific embodiment, provided herein are antibodies that competitively inhibit (e.g., in a dose dependent manner) an antibody or an antigen-binding fragment thereof that specifically binds to VISTA described herein from binding to VISTA, as determined using any of assays known to one of skill in the art or described herein, for example, ELISA competitive assays, suspension array, BLI (e.g., BLI on the Octet Red 96 (ForteBio) system, or surface plasmon resonance).

In certain embodiments, provided herein is an antibody that competes with an antibody or an antigen-binding fragment thereof that specifically binds to VISTA described herein for binding to VISTA to the same extent that the antibody described herein self-competes for binding to VISTA. In certain embodiments, provided herein is a first antibody that competes with an antibody or an antigen-binding fragment thereof that specifically binds to VISTA described herein for binding to VISTA, wherein the competition is exhibited as reduced binding of the first antibody to VISTA by more than 80% (e.g., 85%, 90%, 95%, or 98%, or between 80% to 85%, 80% to 90%, 85% to 90%, or 85% to 95%).

An antibody or antigen-binding fragment thereof that competes with an antibody or an antigen-binding fragment thereof that specifically binds to VISTA described herein for binding to VISTA may be a human antibody, a humanized antibody or a chimeric antibody.

In specific aspects, provided herein is an antibody which competes (e.g., in a dose dependent manner) for specific binding to VISTA with an antibody comprising the VH of an antibody set forth in Table 7, and a VL of the same antibody set forth in Table 8. In specific embodiments, provided herein is an antibody which competes (e.g., in a dose dependent manner) for specific binding to VISTA with an immunoglobulin comprising a light chain of an antibody set forth in Table 9 and the heavy chain of the same antibody set forth in Table 9.

In specific embodiments, an antibody or an antigen-binding fragment thereof that specifically binds to the same or an overlapping epitope of an antibody comprising the VH of an antibody set forth in Table 7 and the VL of the same antibody set forth in Table 8. Assays known to one of skill in the art or described herein (e.g., X-ray crystallography, ELISA assays, etc.) can be used to determine if two antibodies bind to the same epitope.

In certain embodiments, an antibody or an antigen-binding fragment thereof that competes with an antibody or an antigen-binding fragment thereof that specifically binds to VISTA described herein for binding to VISTA, or an antibody or antigen-binding fragment thereof that binds to the same or an overlapping epitope of an antibody or an antigen-binding fragment thereof that specifically binds to VISTA described herein, binds to the ECD of human VISTA with a $K_D$ of about 0.5 nM to about 1 nM, about 1 nM to about 1.5 nM, about 1.5 nM to about 2 nM, about 2 nM to about 2.5 nM, about 2.5 nM to about 3 nM, about 3 nM to about 5 nM, about 5 nM to about 10 nM, about 10 nM to about 20 nM, or about 20 nM to about 100 nMas determined by biolayer interferometry or another method known in the art.

In specific embodiments, an antibody or an antigen-binding fragment thereof, that competes with an antibody or an antigen-binding fragment thereof that specifically binds to VISTA described herein for binding to VISTA, or an antibody or antigen-binding fragment thereof that binds to the same or an overlapping epitope of an antibody or an antigen-binding fragment thereof that specifically binds to VISTA described herein, binds to the ECD of cynomolgus monkey VISTA with a $K_D$ of about 0.5 nM to about 1 nM, about 1 nM to about 1.5 nM, about 1.5 nM to about 2 nM, about 2 nM to about 2.5 nM, about 2.5 nM to about 3 nM, about 3 nM to about 5 nM, about 5 nM to about 10 nM, about 10 nM to about 20 nM, or about 20 nM to about 100 nM as determined by biolayer interferometry.

In specific embodiments an antibody or an antigen-binding fragment thereof, that competes with an antibody or an antigen-binding fragment thereof that specifically binds to VISTA described herein for binding to VISTA, or an antibody or antigen-binding fragment thereof that binds to the same or an overlapping epitope of an antibody or an antigen-binding fragment thereof that specifically binds to VISTA described herein, binds to human VISTA with an half-effective concentration ($EC_{50}$) of about 0.5 nM, about 0.9 nM, about 1.6 nM, about 1.7 nM, about 2.1 nM, about 2.7 nM, about 3.2 nM, about 4.2 nM, about 5.5 nM, or about 11.7 nM as measured by ELISA.

In specific embodiments, an antibody or an antigen-binding fragment thereof that competes with an antibody or an antigen-binding fragment thereof that specifically binds to VISTA described herein for binding to VISTA, or an antibody or antigen-binding fragment thereof that binds to the same or an overlapping epitope of an antibody or an antigen-binding fragment thereof that specifically binds to VISTA described herein, binds to human VISTA on the surface of cells with an $EC_{50}$ of about 0.05 nM, about 0.06 nM, about 0.09 nM, about 0.1 nM, about 0.2 nM, about 0.3 nM, about 0.4 nM, about 0.6 nM, about 0.8 nM or about 1.2 nM.

In specific embodiments, an antibody or an antigen-binding fragment thereof described herein, that competes with an antibody or an antigen-binding fragment thereof that specifically binds to VISTA described herein for binding to VISTA, or an antibody or antigen-binding fragment thereof that binds to the same or an overlapping epitope of an antibody or an antigen-binding fragment thereof that specifically binds to VISTA described herein, does not bind to B7-1 (also known as CD80), B7-2 (also known as CD86), B7-H2 (also known as ICOS ligand), B7-H1 (also known as PD-L1 or CD274), B7-DC (also known as PD-L2 or CD273), B7-H4 (also known as B7S1), and/or B7-H3 (also known as CD276).

In specific embodiments, an antibody or an antigen-binding fragment thereof described herein, that competes with an antibody or an antigen-binding fragment thereof that specifically binds to VISTA described herein for binding to VISTA, or an antibody or antigen-binding fragment thereof that binds to the same or an overlapping epitope of an antibody or an antigen-binding fragment thereof that specifically binds to VISTA described herein, blocks the interaction between VSIG3 and VISTA. In specific embodiments, an antibody or antigen-binding fragment thereof blocks VISTA dimerization or other homotypic interaction. In specific embodiments, an antibody or antigen-binding fragment thereof blocks the interaction between PSGL1 and VISTA. In specific embodiments, an antibody or antigen-binding fragment thereof blocks the interaction between VSIG8 and VISTA. In specific embodiments, an antibody or antigen-binding fragment thereof blocks the interaction between LRIG1 and VISTA.

As used herein, the terms "about" when used to modify a numeric value or numeric range, indicate that deviations of 5% to 10% above and 5% to 10% below the value or range remain within the intended meaning of the recited value or range.

Functional Characteristics

In specific embodiments, an antibody or an antigen-binding fragment thereof that specifically binds to VISTA described herein increases human T cell activation. Human T cell activation may be determined by any assay known in the art or described herein (e.g., the SEB-induced human T cell activation assay described below). In certain embodiments, an antibody or an antigen-binding fragment thereof that specifically binds to VISTA described herein increases human T cell activation by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190% or about 200% compared to an IgG1 or IgG4 control.

In specific embodiments, an antibody or an antigen-binding fragment thereof that specifically binds to VISTA described herein decreases VISTA-mediated T cell suppression. VISTA-mediated T cell suppression may be determined using any assay known in the art or described herein (e.g., by measuring IFNγ production using an ELISA, or by measuring T cell proliferation, as described below). In particular embodiments, an antibody or an antigen-binding fragment thereof that specifically binds to VISTA described herein decreases VISTA-mediated T cell suppression by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, about 200%, about 210%, about 220%, about 230%, about 240%, about 250%, about 260%, about 270%, about 280%, about 290%, or about 300% compared to an IgG1 control as determined by T cell proliferation.

In other particular embodiments, an antibody or an antigen-binding fragment thereof that specifically binds to VISTA described herein decreases VISTA-mediated T cell suppression by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, about 200%, about 210%, about 220%, about 230%, about 240%, about 250%, about 260%, about 270%, about 280%, about 290%, or about 300% compared to an IgG1 or IgG4 control as determined by IFNγ production.

In specific embodiments, an antibody or an antigen-binding fragment thereof that specifically binds to VISTA described herein activates monocytes. Monocyte activation can be determined using any assays known in the art or described herein (e.g., by measuring levels of HLA-DR, CD80 and/or CD86 on the surface of CD14+ cells, or by measuring CXCL10 chemokine secretion, as described below). In particular embodiments, an antibody or an antigen-binding fragment thereof that specifically binds to VISTA described herein increases expression of HLA-DR on CD14+ monocytes by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, about 200%, about 210%, about 220%, about 230%, about 240%, about 250%, about 260%, about 270%, about 280%, about 290%, or about 300% compared to an IgG1 or IgG4 control. In a specific embodiment, the increase in HLA-DR expression is NK cell-dependent.

In particular embodiments, an antibody or an antigen-binding fragment thereof that specifically binds to VISTA described herein increases expression of CD80 on CD14+ monocytes by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, about 200%, about 210%, about 220%, about 230%, about 240%, about 250%, about 260%, about 270%, about 280%, about 290%, or about 300% compared to an IgG1 or IgG4 control. In a specific embodiment, the CD80 expression is NK cell-dependent.

In particular embodiments, an antibody or an antigen-binding fragment thereof that specifically binds to VISTA described herein increases expression of CD86 on CD14+ monocytes by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, about 200%, about 210%, about 220%, about 230%, about 240%, about 250%, about 260%, about 270%, about 280%, about 290%, or about 300% compared to an IgG1 or IgG4 control.

In specific embodiments, an antibody or an antigen-binding fragment thereof that specifically binds to VISTA described herein increases secretion of CXCL10 by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, about 200%, about 210%, about 220%, about 230%, about 240%, about 250%, about 260%, about 270%, about 280%, about 290%, about 300%, about 310%, about 320%, about 330%, about 340%, about 350%, about 360%, about 370%, about 380%, about 390%, about 400%, about 410%, about 420%, about 430%, about 440%, about 450%, about 460%, about 470%, about 480%, about 490%, or about 500% compared to an IgG1 or IgG4 control. In a specific embodiment, the CXCL10 secretion is NK cell-dependent.

In specific embodiments, an antibody or an antigen-binding fragment thereof that specifically binds to VISTA described herein affects cytokine-induced activation of myeloid-derived suppressor cells (MDSCs). Activity of MDSCs can be determined using any assay known in the art or described herein (e.g., by measuring the ability of MDSCs to inhibit anti-CD3-induced T cell proliferation by flow cytometry and/or measuring IFNγ production by ELISA as described below.)

In specific embodiments, an antibody or an antigen-binding fragment thereof that specifically binds to VISTA described herein reduces MDSC-mediated T cell suppression by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, or about 200% compared to an IgG1 control as determined by T cell proliferation.

In particular embodiments, an antibody or an antigen-binding fragment thereof that specifically binds to VISTA described herein reduces MDSC-mediated T cell suppression by about 10%, about 20%, about 30%, about 40%, about 50%, about 60%, about 70%, about 80%, about 90%, about 100%, about 110%, about 120%, about 130%, about 140%, about 150%, about 160%, about 170%, about 180%, about 190%, about 200%, about 210%, about 220%, about 230%, about 240%, about 250%, about 260%, about 270%, about 280%, about 290%, about 300%, about 310%, about 320%, about 330%, about 340%, about 350%, about 360%, about 370%, about 380%, about 390%, about 400%, about 410%, about 420%, about 430%, about 440%, about 450%, about 460%, about 470%, about 480%, about 490%, or about 500% compared to an IgG1 control as determined by IFNγ secretion.

In specific embodiments, an antibody or an antigen-binding fragment thereof that specifically binds to VISTA described herein induces antibody-dependent cell cytotoxicity (ADCC). ADCC may be determined by any assay known in the art or described herein (e.g., by measuring ADCC against Raji cells expressing human VISTA, as described below). In particular embodiments, an antibody or an antigen-binding fragment thereof that specifically binds to VISTA described herein induces ADCC with a half-maximal effective concentration ($EC_{50}$) of about 1-5 ng/mL, about 5-10 ng/mL, about 10-15 ng/mL, about 15-20 ng/mL or about 20-25 ng/mL, or with an $EC_{50}$ of about 10.78 ng/mL, about 5.24 ng/mL, about 5.75 ng/mL, about 15.7 ng/mL, about 7.94 ng/mL, about 8.5 ng/mL, about 15.6 ng/mL, or about 22.1 ng/mL.

In specific embodiments, an antibody or an antigen-binding fragment thereof that specifically binds to VISTA described herein inhibits tumor formation or tumor growth in an in vivo model of cancer. In specific embodiments, the in vivo model of cancer is a human VISTA knock-in ("hVISTA KI") mouse, an MC38 mouse model, a MB49 mouse model, or an EG7 mouse model. In specific embodiments, an antibody or an antigen-binding fragment thereof that specifically binds to VISTA described herein inhibits tumor formation or tumor growth in an MC38 mouse model of colorectal cancer. An exemplary protocol for determining inhibition of tumor formation in an MC38 mouse model is shown below). In particular embodiments, an antibody or an antigen-binding fragment thereof that specifically binds to VISTA described herein shows greater inhibition of tumor growth in an MC38 mouse model than a mouse IgG2a control. In other particular embodiments, an antibody or an antigen-binding fragment thereof that specifically binds to VISTA described herein shows greater inhibition of tumor growth in an MC38 mouse model than an anti-PD-1 antibody.

In specific embodiments, an antibody or an antigen-binding fragment thereof that specifically binds to VISTA described herein inhibits tumor growth in an MB49 mouse model of bladder cancer. An exemplary protocol for determining inhibition of tumor formation in an MB49 mouse model is shown below). In particular embodiments, an antibody or an antigen-binding fragment thereof that specifically binds to VISTA described herein shows greater inhibition of tumor growth in an MB49 mouse model than a mouse IgG2a control.

In specific embodiments, an antibody or an antigen-binding fragment thereof that specifically binds to VISTA described herein inhibits tumor growth in an EG7 mouse model of thymoma. An exemplary protocol for determining inhibition of tumor formation in an EG7 mouse model is shown below). In particular embodiments, an antibody or an antigen-binding fragment thereof that specifically binds to VISTA described herein shows greater inhibition of tumor growth in an EG7 mouse model than a mouse IgG2a control.

In specific embodiments, an antibody or an antigen-binding fragment thereof that specifically binds to VISTA described herein has an elimination half-life of about 9 hours after an intraperitoneal injection of 10 mg/kg in a hVISTA KI mouse. In specific embodiments, an antibody or an antigen-binding fragment thereof that specifically binds to VISTA described herein has an elimination half-life of about 33 hours after an intraperitoneal injection of 30 mg/kg or 100 mg/kg in a hVISTA KI mouse.

In specific embodiments, an antibody or an antigen-binding fragment thereof that specifically binds to VISTA described herein modulates myeloid cell activation markers in the blood. Myeloid activation markers include, for example, CD80, CD86, HLA-DR and may be measured by any assay known in the art or described herein (e.g., by measuring the expression of CD80, CD86, HLA-DR on myeloid dendritic cells (mDCs) or monocytes by flow cytometry as described in below).

1.2 Antibody Production

Producing and Screening Antibodies

In another aspect, provided herein are methods of producing antibodies or antigen-binding fragments thereof that specifically binds to VISTA described herein.

The antibodies or antigen-binding fragments thereof described herein can be produced by any method known in the art for the synthesis of antibodies, for example, by chemical synthesis or by recombinant expression techniques. The methods described herein employs, unless otherwise indicated, conventional techniques in molecular biology, microbiology, genetic analysis, recombinant DNA, organic chemistry, biochemistry, PCR, oligonucleotide synthesis and modification, nucleic acid hybridization, and related fields within the skill of the art. These techniques are described, for example, in the references cited herein and are fully explained in the literature. See, e.g., Maniatis T et al., (1982) Molecular Cloning: A Laboratory Manual, Cold Spring Harbor Laboratory Press; Sambrook J et al., (1989), Molecular Cloning: A Laboratory Manual, Second Edition, Cold Spring Harbor Laboratory Press; Sambrook J et al., (2001) Molecular Cloning: A Laboratory Manual, Cold Spring Harbor Laboratory Press, Cold Spring Harbor, NY; Ausubel F M et al., Current Protocols in Molecular Biology, John Wiley & Sons (1987 and annual updates); Current Protocols in Immunology, John Wiley & Sons (1987 and annual updates) Gait (ed.) (1984) Oligonucleotide Synthesis: A Practical Approach, IRL Press; Eckstein (ed.) (1991) Oligonucleotides and Analogues: A Practical Approach, IRL Press; Birren B et al., (eds.) (1999) Genome Analysis: A Laboratory Manual, Cold Spring Harbor Laboratory Press.

In specific embodiments, an antibody described herein is an antibody (e.g., recombinant antibody) prepared, expressed, created or isolated by any means that involves creation, e.g., via synthesis, genetic engineering of DNA sequences. In certain embodiments, such antibody comprises sequences that are encoded by DNA sequences that do not naturally exist within the antibody germline repertoire of an animal or mammal (e.g., human) in vivo. In specific embodiments, an antibody described herein is made by a method comprising using mature human VISTA (amino acids 33-311 of SEQ ID NO: 377) or the extracellular domain thereof (SEQ ID NO: 378) as an immunogen.

In a certain aspect, provided herein is a method of making an antibody or an antigen-binding fragment thereof that specifically binds to VISTA, comprising culturing a cell or host cell described herein. In a certain aspect, provided herein is a method of making an antibody or an antigen-binding fragment thereof that specifically binds to VISTA comprising expressing (e.g., recombinantly expressing) the antibody or antigen-binding fragment thereof using a cell or host cell described herein (e.g., a cell or a host cell comprising polynucleotides encoding an antibody described herein). In a particular embodiment, the cell is an isolated or ex vivo cell. In a particular embodiment, the exogenous polynucleotides have been introduced into the cell. In a particular embodiment, the method further comprises the step of purifying the antibody or antigen-binding fragment thereof obtained from the cell or host cell.

Methods for producing polyclonal antibodies are known in the art (see, for example, Chapter 11 in: Short Protocols in Molecular Biology, (2002) 5th Ed., Ausubel F M et al., eds., John Wiley and Sons, New York).

The term "monoclonal antibody" as used herein is not limited to antibodies produced through hybridoma technology. Monoclonal antibodies can be prepared using a wide variety of techniques known in the art including the use of hybridoma, recombinant, and phage display technologies, or a combination thereof. For example, monoclonal antibodies can be produced recombinantly from host cells exogenously expressing an antibody described herein or a fragment thereof, for example, a light chain and/or heavy chain of such antibody. Methods for the preparation of clonal cell lines and of monoclonal antibodies expressed thereby are well known in the art (see, for example, Chapter 11 in Short Protocols in Molecular Biology, (2002) 5th Ed., Ausubel F M et al., supra). For example, monoclonal antibodies can be produced using hybridoma techniques including those known in the art and taught, for example, in Harlow E & Lane D, Antibodies: A Laboratory Manual, (Cold Spring Harbor Laboratory Press, 2nd ed. 1988); Hannerling G J et al., in: Monoclonal Antibodies and T-Cell Hybridomas 563 681 (Elsevier, N.Y., 1981); and Kohler G & Milstein C (1975) Nature 256: 495. Methods for producing and screening for specific antibodies using hybridoma technology are routine and well known in the art. In specific embodiments, mice (or other animals, such as, for example, rats, monkeys, donkeys, pigs, sheep, hamster, cows, camels, chickens, or dogs) can be immunized with an antigen (e.g., human) and once an immune response is detected, e.g., antibodies specific for the antigen are detected in the mouse serum, the mouse spleen is harvested and splenocytes isolated. The splenocytes are then fused by well-known techniques to any suitable myeloma cells, for example cells from cell line SP2/0 available from the American Type Culture Collection (ATCC®) (Manassas, VA), to form hybridomas. Hybridomas are selected and cloned by limited dilution. The hybridoma cells thus prepared are seeded and grown in a suitable culture medium that preferably contains one or more substances that inhibit the growth or survival of the unfused, parental myeloma cells. Culture medium in which hybridoma cells are growing is assayed for production of monoclonal antibodies directed against VISTA. After hybridoma cells that produce antibodies of the desired specificity, affinity, and/or activity are identified, the clones may be subcloned, grown, and separated from the culture medium by standard methods (Goding J W (Ed), Monoclonal Antibodies: Principles and Practice, supra). The binding specificity of monoclonal antibodies produced by hybridoma cells is determined by methods known in the art, for example, immunoprecipitation or by an in vitro binding assay, such as, for example, radioimmunoassay (RIA) or enzyme-linked immunoabsorbent assay (ELISA).

In specific embodiments, disclosed herein are monoclonal antibodies that are produced by a single cell (e.g., a single B cell, a hybridoma, or a host cell producing a recombinant antibody), wherein the antibody immunospecifically binds to VISTA as determined, e.g., by ELISA or other antigen-binding or competitive binding assay known in the art or as described herein. In certain embodiments, a monoclonal antibody is a monovalent antibody or multivalent (e.g., bivalent) antibody. In particular embodiments, a monoclonal antibody is a monospecific or multispecific antibody (e.g., bispecific antibody or a trispecific antibody). In specific embodiments, an antibody provided herein is a bispecific T cell engager (BiTE). In some embodiments, an antibody provided herein is a tri-specific killer engager (TriKE).

Antibody fragments which recognize VISTA can be generated by any technique known to those of skill in the art. For example, Fab and $F(ab')_2$ fragments described herein can be produced by proteolytic cleavage of immunoglobulin molecules, using enzymes such as, for example, papain (to produce Fab fragments) or pepsin (to produce $F(ab')_2$ fragments). A Fab fragment corresponds to one of the two identical arms of an antibody molecule and contains the complete light chain paired with the VH and CH1 domains of the heavy chain. A $F(ab')_2$ fragment contains the two antigen-binding arms of an antibody molecule linked by disulfide bonds in the hinge region.

Further, an antibody or an antigen-binding fragment thereof that specifically binds to VISTA described herein, can also be generated using various phage display methods known in the art. In phage display methods, functional antibody domains are displayed on the surface of phage particles which carry the polynucleotide sequences encoding them. In particular, DNA sequences encoding VH and VL domains are amplified from animal cDNA libraries (e.g., human or murine cDNA libraries of affected tissues). The DNA encoding the VH and VL domains are recombined together with a scFv linker by PCR and cloned into a phagemid vector. The vector is electroporated into *E. coli* cells and the *E. coli* is infected with helper phage. Phage used in these methods are typically filamentous phage including fd and M13, and the VH and VL domains are usually recombinantly fused to either the phage gene III or gene VIII. Phage expressing an antigen binding domain that binds to a particular antigen can be selected or identified with antigen, e.g., using labeled antigen or antigen bound or captured to a solid surface or bead. Examples of phage display methods that can be used to make the antibodies described herein include those disclosed in Brinkman U et al., (1995) J Immunol Methods 182: 41-50; Ames R S et al., (1995) J Immunol Methods 184: 177-186; Kettleborough C A et al., (1994) Eur J Immunol 24: 952-958; Persic L et al., (1997) Gene 187: 9-18; Burton D R & Barbas C F (1994) Advan Immunol 57: 191-280; PCT Application No. PCT/GB91/001134; International Publication Nos. WO 90/02809, WO 91/10737, WO 92/01047, WO 92/18619, WO 93/11236, WO 95/15982, WO 95/20401, and WO 97/13844; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727, 5,733,743 and 5,969,108.

As described in the above references, after phage selection, the antibody coding regions from the phage can be isolated and used to generate whole antibodies, including humanized antibodies, chimeric antibodies, or any other desired antigen-binding fragment, and expressed in any desired host, including mammalian cells, insect cells, plant cells, yeast, and bacteria, e.g., as described below. Techniques to recombinantly produce antibody fragments such as, for example, Fab, Fab' and $F(ab')_2$ fragments can also be employed using methods known in the art such as, for example, those disclosed in PCT publication No. WO 92/22324; Mullinax R L et al., (1992) BioTechniques 12(6): 864-9; Sawai H et al., (1995) Am J Reprod Immunol 34: 26-34; and Better M et al., (1988) Science 240: 1041-1043.

In one aspect, to generate whole antibodies, PCR primers including VH or VL nucleotide sequences, a restriction site, and a flanking sequence to protect the restriction site can be used to amplify the VH or VL sequences from a template, e.g., scFv clones. Utilizing cloning techniques known to those of skill in the art, the PCR amplified VH domains can be cloned into vectors expressing a heavy chain constant region, and the PCR amplified VL domains can be cloned into vectors expressing a light chain constant region, e.g., human kappa or lambda constant regions. The VH and VL domains can also be cloned into one vector expressing the necessary constant regions. The heavy chain conversion vectors and light chain conversion vectors are then co-transfected into cell lines to generate stable or transient cell lines that express full-length antibodies, e.g., IgG, using techniques known to those of skill in the art.

Single domain antibodies, for example, antibodies lacking the light chains, can be produced by methods well known in the art. See Riechmann L & Muyldermans S (1999) J Immunol 231: 25-38; Nuttall S D et al., (2000) Curr Pharm Biotechnol 1(3): 253-263; Muyldermans S, (2001) J Biotechnol 74(4): 277-302; U.S. Pat. No. 6,005,079; and International Publication Nos. WO 94/04678, WO 94/25591 and WO 01/44301.

Further, antibodies that immunospecifically bind to a VISTA antigen can, in turn, be utilized to generate anti-idiotype antibodies that "mimic" an antigen using techniques well known to those skilled in the art. (See, e.g., Greenspan N S & Bona C A (1989) FASEB J 7(5): 437-444; and Nissinoff A (1991) J Immunol 147(8): 2429-2438).

Human antibodies can be produced using any method known in the art. For example, transgenic mice which are incapable of expressing functional endogenous immunoglobulins, but which can express human immunoglobulin genes, can be used. In particular, the human heavy and light chain immunoglobulin gene complexes can be introduced randomly or by homologous recombination into mouse embryonic stem cells. Alternatively, the human variable region, constant region, and diversity region can be introduced into mouse embryonic stem cells in addition to the human heavy and light chain genes. The mouse heavy and light chain immunoglobulin genes can be rendered non-functional separately or simultaneously with the introduction of human immunoglobulin loci by homologous recombination. In particular, homozygous deletion of the JH region prevents endogenous antibody production. The modified embryonic stem cells are expanded and microinjected into blastocysts to produce chimeric mice. The chimeric mice are then bred to produce homozygous offspring which express human antibodies. The transgenic mice are immunized in the normal fashion with a selected antigen, e.g., all or a portion of an antigen (e.g., VISTA, or the ECD of VISTA, or VISTA-encoding DNA). Monoclonal antibodies directed against the antigen can be obtained from the immunized, transgenic mice using single B cell or hybridoma technology. The human immunoglobulin transgenes harbored by the transgenic mice rearrange during B cell differentiation, and subsequently undergo class switching recombination and somatic hyper-mutation. Thus, using such a technique, it is possible to produce therapeutically useful IgG, IgA, IgM and IgE antibodies. For an overview of this technology for producing human antibodies, see, e.g., Lonberg N & Huszar D (1995) Int Rev Immunol 13:65-93. For a detailed discussion of this technology for producing human antibodies and human monoclonal antibodies and protocols for producing such antibodies, see, e.g., International Publication Nos. WO 98/24893, WO 96/34096 and WO 96/33735; and U.S. Pat. Nos. 5,413,923, 5,625,126, 5,633,425, 5,569,825, 5,661,016, 5,545,806, 5,814,318 and 5,939,598. Examples of mice capable of producing human antibodies include the Trianni® mouse (described in, e.g., U.S. Pat. Nos. 10,881,084 and 10,793,829), the Xenomouse™ (Abgenix, Inc.; U.S. Pat. Nos. 6,075,181 and 6,150,184), the HuAb-Mouse™ (Medarex, Inc./Gen Pharm; U.S. Pat. Nos. 5,545,806 and 5,569,825), the Trans Chromo Mouse™ (Kirin) and the KM Mouse™ (Medarex/Kirin).

Human antibodies which specifically bind to VISTA can be made by a variety of methods known in the art including phage display methods described above using antibody libraries derived from human immunoglobulin sequences. See also U.S. Pat. Nos. 4,444,887, 4,716,111, and 5,885,793; and International Publication Nos. WO 98/46645, WO 98/50433, WO 98/24893, WO 98/16654, WO 96/34096, WO 96/33735, and WO 91/10741.

In specific embodiments, human antibodies can be produced using mouse-human hybridomas. For example, human peripheral blood lymphocytes transformed with Epstein-Barr virus (EBV) can be fused with mouse myeloma cells to produce mouse-human hybridomas secreting human monoclonal antibodies, and these mouse-human hybridomas can be screened to determine ones which secrete human monoclonal antibodies that immunospecifically bind to a target antigen (e.g., human VISTA or the ECD of human VISTA). Such methods are known and are described in the art, see, e.g., Shinmoto H et al., (2004) Cytotechnology 46: 19-23; Naganawa Y et al., (2005) Human Antibodies 14: 27-31.

In specific embodiments, the methods of screening and selecting antibodies or antigen-binding fragments thereof described herein, which specifically bind to VISTA are as described herein.

Once an antibody or an antigen-binding fragment thereof that specifically binds to VISTA described herein has been produced, it can be purified by any method known in the art for purification of an immunoglobulin molecule, for example, by chromatography (e.g., ion exchange, affinity, particularly by affinity for the specific antigen after Protein A, and sizing column chromatography), centrifugation, differential solubility, or by any other standard technique for the purification of proteins. Further, the antibodies described herein can be fused to heterologous polypeptide sequences described herein or otherwise known in the art to facilitate purification.

In specific embodiments, an antibody or an antigen-binding fragment thereof that specifically binds to VISTA described herein is isolated or purified. In a specific embodiment, an antibody or an antigen-binding fragment thereof that specifically binds to VISTA described herein is substantially free of other antibodies with different antigenic specificities than the isolated antibody. For example, in a particular embodiment, a preparation of an antibody described herein is substantially free of cellular material and/or chemical precursors. The language "substantially free of cellular material" includes preparations of an antibody in which the antibody is separated from cellular components of the cells from which it is isolated or recombinantly produced. Thus, an antibody that is substantially free of cellular material includes preparations of antibody having less than about 30%, 20%, 10%, 5%, 2%, 1%, 0.5%, or 0.1% (by dry weight) of heterologous protein (also referred to herein as a “contaminating protein”) and/or variants of an antibody, for example, different post-translational modified forms of an antibody or other different versions of an antibody (e.g., antibody fragments). When the antibody is recombinantly produced, it is also generally substantially free of culture medium, i.e., culture medium represents less than about 20%, 10%, 2%, 1%, 0.5%, or 0.1% of the volume of the protein preparation. When the antibody is produced by chemical synthesis, it is generally substantially free of chemical precursors or other chemicals, i.e., it is separated from chemical precursors or other chemicals which are involved in the synthesis of the protein as well as from misfolded proteins and other precursors. Accordingly, such preparations of the antibody have less than about 30%, 20%, 10%, or 5% (by dry weight) of chemical precursors or compounds other than the antibody of interest.

1.3 Polynucleotides

In certain aspects, provided herein are one or more polynucleotides (or nucleic acid molecules) comprising one or more nucleotide sequences encoding an antibody or an antigen-binding fragment thereof that specifically binds to VISTA described herein and vectors, e.g., vectors comprising such polynucleotides for their efficient expression in host cells (e.g., *E. coli* and mammalian cells), as well as ex vivo host cells containing and optionally expressing such antibody or antigen-binding fragment. In specific embodiments, a polynucleotide is isolated or purified.

In a specific embodiment, the polynucleotide or nucleic acid molecule is one which is separated from other nucleic acid molecules which are present in the natural source (e.g., in a mouse or a human) of the nucleic acid molecule. Moreover, the nucleic acid molecule, such as, for example, a cDNA molecule, can be substantially free of other cellular material, or culture medium when produced by recombinant techniques, or substantially free of chemical precursors or other chemicals when chemically synthesized. For example, the language “substantially free” includes preparations of polynucleotide or nucleic acid molecule having less than about 15%, 10%, 5%, 2%, 1%, 0.5%, or 0.1% of other material, e.g., cellular material, culture medium, other nucleic acid molecules, chemical precursors and/or other chemicals.

In particular aspects, provided herein are polynucleotides comprising nucleotide sequences encoding antibody or an antigen-binding fragment thereof that specifically binds to VISTA described herein, which comprises an amino acid sequence as described herein, as well as antibodies which compete with such antibodies for binding to a VISTA polypeptide (e.g., in a dose-dependent manner), or which binds to the same or an overlapping epitope as that of such antibodies.

In certain aspects, provided herein are polynucleotides comprising a nucleotide sequence encoding the light chain and/or heavy chain of an antibody described herein.

In specific embodiments, a polynucleotide comprises a nucleotide sequence encoding the VH of an antibody or an antigen-binding fragment thereof that specifically binds to VISTA described herein, e.g., the VH of an antibody set forth in Table 7. In specific embodiments, a polynucleotide comprises a nucleotide sequence encoding the VL of an antibody or an antigen-binding fragment thereof that specifically binds to VISTA described herein, e.g., the VL of an antibody set forth in Table 8. In specific embodiments, a polynucleotide comprises a nucleotide sequence encoding both VH and the VL of an antibody or an antigen-binding fragment thereof that specifically binds to VISTA described herein, e.g., the VH of an antibody set forth in Table 7 and the VL of the same antibody set forth in Table 8. In a specific embodiment, the VH and the VL can be encoded by separate polynucleotides.

In specific aspects, provided herein is a polynucleotide comprising a nucleotide sequence encoding an antibody comprising a light chain and a heavy chain, e.g., a separate light chain and heavy chain. In a specific embodiment, the light chain and heavy chain can be encoded by separate polynucleotides. With respect to the light chain, in specific embodiments, a polynucleotide provided herein comprises a nucleotide sequence encoding an antibody described herein comprising a human kappa light chain or a human lambda light chain.

In specific embodiments, a polynucleotide provided herein comprises a nucleotide sequence encoding a heavy chain of an antibody, wherein the nucleotide sequence comprises a sequence set forth in Table 12. In specific embodiments, a polynucleotide provided herein comprises a nucleotide sequence encoding a light chain of an antibody, wherein the nucleotide sequence comprises a sequence set forth in Table 13.

In specific embodiments, a polynucleotide comprises a nucleotide sequence encoding the VH of an antibody or an antigen-binding fragment thereof that specifically binds to VISTA described herein, e.g., the VH of an antibody set forth in Table 7 and a human heavy chain constant region (e.g., a human alpha (α), delta (δ), epsilon (ε), gamma (γ) or mu (μ) heavy chain constant region). In specific embodiments, a polynucleotide comprises a nucleotide sequence encoding the VL of an antibody or an antigen-binding fragment thereof that specifically binds to VISTA described herein, e.g., the VL of an antibody set forth in Table 8 and a human light chain constant region (e.g., a human kappa light chain or a human lambda light chain constant region).

In specific embodiments, one or more polynucleotides comprise (i) a nucleotide sequence encoding the VH of an antibody or an antigen-binding fragment thereof that specifically binds to VISTA described herein (e.g., the VH of an antibody set forth in Table 7) and a human heavy chain constant region (e.g., a human alpha (α), delta (δ), epsilon (ε), gamma (γ) or mu (μ) heavy chain constant region); and (ii) a nucleotide sequence encoding the VL of an antibody or an antigen-binding fragment thereof that specifically binds to VISTA described herein (e.g., the VL of an antibody set forth in Table 8) and a human light chain constant region (e.g., a human kappa light chain or a human lambda light chain constant region). In particular embodiments, one or more polynucleotides provided herein comprise nucleotide sequences encoding the heavy and light chains of antibody or an antigen-binding fragment thereof that specifically binds to VISTA, wherein the nucleotide sequences comprise a sequence set forth in Table 12 and a sequence of the same antibody set forth in Table 13.

TABLE 12

Nucleotide sequence encoding antibody heavy chains.

| Antibody No. | Heavy Chain Nucleotide Sequence |
|---|---|
| 269.1 | SEQ ID NO: 505 |
| 141.1 | SEQ ID NO: 506 |
| 184.1 | SEQ ID NO: 507 |
| 308.1 | SEQ ID NO: 508 |
| 244.1 | SEQ ID NO: 509 |
| 244.2 | SEQ ID NO: 510 |

TABLE 12-continued

Nucleotide sequence encoding antibody heavy chains.

| Antibody No. | Heavy Chain Nucleotide Sequence |
|---|---|
| 321.1 | SEQ ID NO: 511 |
| 405.1 | SEQ ID NO: 512 |
| 472.1 | SEQ ID NO: 513 |
| 430.1 | SEQ ID NO: 514 |
| 421.1 | SEQ ID NO: 515 |
| 139.1 | SEQ ID NO: 516 |
| 178.1 | SEQ ID NO: 517 |
| 391.1 | SEQ ID NO: 518 |
| 347.1 | SEQ ID NO: 519 |
| 427.1 | SEQ ID NO: 520 |
| 178.2 | SEQ ID NO: 521 |
| 245.1 | SEQ ID NO: 522 |
| 475.1 | SEQ ID NO: 523 |
| 149.1 | SEQ ID NO: 524 |
| 133.1 | SEQ ID NO: 525 |
| 474.1, 373.1, 467.1, 908.1, 386.1, 268.1, 342.1, 259.1 | SEQ ID NO: 526 |
| 338.1 | SEQ ID NO: 527 |
| 419.1 | SEQ ID NO: 528 |
| 277.1 | SEQ ID NO: 529 |
| 946.1 | SEQ ID NO: 530 |
| 322.1 | SEQ ID NO: 531 |
| 346.1 | SEQ ID NO: 532 |
| 304.1 | SEQ ID NO: 533 |
| 814.1 | SEQ ID NO: 534 |
| 210.1 | SEQ ID NO: 535 |
| 460.1 | SEQ ID NO: 536 |
| 245.2 | SEQ ID NO: 537 |
| 474.2 | SEQ ID NO: 538 |
| 542.2 | SEQ ID NO: 539 |
| 245.4 | SEQ ID NO: 540 |
| 465.1 | SEQ ID NO: 541 |
| 341.1 | SEQ ID NO: 542 |
| 228.1 | SEQ ID NO: 543 |
| 444.1 | SEQ ID NO: 544 |
| 395.1 | SEQ ID NO: 545 |
| 564.1 | SEQ ID NO: 546 |
| 564.2 | SEQ ID NO: 547 |
| 465.4 | SEQ ID NO: 548 |
| 457.1 | SEQ ID NO: 549 |
| 266.1 | SEQ ID NO: 550 |
| 329.1 | SEQ ID NO: 551 |
| 426.1 | SEQ ID NO: 552 |
| 195.1 | SEQ ID NO: 553 |
| 195.2 | SEQ ID NO: 554 |
| 173.1, 374.1, 394.1, 213.1, 219.1 | SEQ ID NO: 555 |
| 267.1 | SEQ ID NO: 556 |
| 102.1 | SEQ ID NO: 557 |
| 420.1 | SEQ ID NO: 558 |
| 289.1 | SEQ ID NO: 559 |
| 410.1 | SEQ ID NO: 560 |
| 380.1 | SEQ ID NO: 561 |
| 410.2 | SEQ ID NO: 562 |
| 173.4 | SEQ ID NO: 563 |
| 380.4 | SEQ ID NO: 564 |
| 420.4 | SEQ ID NO: 565 |
| 371.4 | SEQ ID NO: 566 |
| 289.4 | SEQ ID NO: 567 |
| 833.1 | SEQ ID NO: 568 |
| 150.1 | SEQ ID NO: 580 |
| 246.4 | SEQ ID NO: 581 |
| 80 | SEQ ID NO: 610 |
| 83 | SEQ ID NO: 611 |
| 85 | SEQ ID NO: 612 |
| 87 | SEQ ID NO: 613 |
| 91 | SEQ ID NO: 614 |
| 92 | SEQ ID NO: 610 |
| 246.4 optimized | SEQ ID NO: 654 |
| 150.1 optimized | SEQ ID NO: 653 |

TABLE 13

Nucleotide sequences encoding antibody light chains.

| Antibody No. | Light Chain Nucleotide Sequence |
|---|---|
| 269.1, 141.1, 184.1, 308.1, 244.1 | SEQ ID NO: 478 |
| 244.2 | SEQ ID NO: 479 |
| 321.1, 405.1, 472.1, 430.1, 421.1, 139.1, 178.1, 391.1, 347.1, 427.1 | SEQ ID NO: 480 |
| 178.2 | SEQ ID NO: 481 |
| 245.2, 475.1, 149.1, 133.1, 474.1, 338.1, 419.1, 277.1, 946.1, 322.1, 346.1, 304.1, 814.1, 210.1, 460.1 | SEQ ID NO: 482 |
| 373.1 | SEQ ID NO: 483 |
| 467.1 | SEQ ID NO: 484 |
| 908.1 | SEQ ID NO: 485 |
| 386.1 | SEQ ID NO: 486 |
| 268.1 | SEQ ID NO: 487 |
| 342.1 | SEQ ID NO: 488 |
| 259.1 | SEQ ID NO: 489 |
| 245.2, 474.2, 542.2 | SEQ ID NO: 490 |
| 245.4 | SEQ ID NO: 491 |
| 465.1, 341.1, 228.1, 444.1, 395.1, 564.1 | SEQ ID NO: 492 |
| 564.2 | SEQ ID NO: 493 |
| 465.4 | SEQ ID NO: 494 |
| 457.1, 266.1, 329.1, 426.1, 195.1 | SEQ ID NO: 495 |
| 195.2 | SEQ ID NO: 496 |
| 173.1, 267.1, 102.1, 420.1, 289.1, 410.1, 380.1, | SEQ ID NO: 497 |
| 374.1 | SEQ ID NO: 498 |
| 394.1 | SEQ ID NO: 499 |
| 213.1 | SEQ ID NO: 500 |
| 219.1 | SEQ ID NO: 501 |
| 410.2 | SEQ ID NO: 502 |
| 173.4, 380.4, 420.4, 371.4, 289.4 | SEQ ID NO: 503 |
| 833.1 | SEQ ID NO: 504 |
| 150.1 | SEQ ID NO: 582 |
| 246.4 | SEQ ID NO: 583 |
| 80 | SEQ ID NO: 615 |
| 83 | SEQ ID NO: 616 |
| 85 | SEQ ID NO: 617 |
| 87 | SEQ ID NO: 618 |
| 91 | SEQ ID NO: 619 |
| 92 | SEQ ID NO: 620 |
| 150.1 | SEQ ID NO: 652 |
| 246.4 | SEQ ID NO: 652 |

In certain embodiments, a polynucleotide(s), nucleic acid(s) or nucleotide(s) includes deoxyribonucleic acids, ribonucleic acids, ribonucleotides, and polymeric forms thereof. In specific embodiments, the polynucleotides(s), nucleic acid(s) or nucleotide(s) is single or double stranded. In specific embodiments, a polynucleotide, nucleic acid, or nucleotide sequence is a cDNA sequence.

In specific embodiments, a polynucleotide sequence described herein (e.g., a nucleic acid sequence) encoding an antibody or an antigen-binding fragment thereof that specifically binds to VISTA described herein is codon optimized using methodology known to one of skill in the art. In certain embodiments, an optimized polynucleotide sequence encoding an antibody or an antigen-binding fragment thereof that specifically binds to VISTA described herein (e.g., VH domain and/or VL domain) can hybridize to an antisense (e.g., complementary) polynucleotide of an unoptimized polynucleotide sequence encoding an antibody or an antigen-binding fragment thereof that specifically binds to VISTA described herein (e.g., VH domain and/or VL domain). In specific embodiments, an optimized nucleotide sequence encoding an antibody or an antigen-binding fragment thereof that specifically binds to VISTA described herein, hybridizes under high stringency conditions to antisense polynucleotide of an unoptimized polynucleotide sequence encoding an antibody or an antigen-binding fragment thereof that specifically binds to VISTA described herein. In specific embodiments, an optimized nucleotide sequence encoding an antibody or an antigen-binding fragment thereof that specifically binds to VISTA hybridizes under high stringency, intermediate or lower stringency hybridization conditions to an antisense polynucleotide of an unoptimized nucleotide sequence encoding an antibody or an antigen-binding fragment thereof that specifically binds to VISTA described herein. Information regarding hybridization conditions has been described, see, e.g., U.S. Patent Application Publication No. US 2005/0048549 (e.g., paragraphs 72-73), which is incorporated herein by reference.

The polynucleotides can be obtained, and the nucleotide sequence of the polynucleotides determined, by any method known in the art. Nucleotide sequences encoding antibodies described herein, and modified versions of these antibodies can be determined using methods well known in the art, i.e., nucleotide codons known to encode particular amino acids are assembled in such a way to generate a nucleic acid sequence that encodes the antibody. Such a polynucleotide encoding the antibody can be assembled from chemically synthesized oligonucleotides (e.g., as described in Kutmeier G et al., (1994), BioTechniques 17: 242-6), which, briefly, involves the synthesis of overlapping oligonucleotides containing portions of the sequence encoding the antibody, annealing and ligating of those oligonucleotides, and then amplification of the ligated oligonucleotides by PCR.

Alternatively, a polynucleotide encoding an antibody or an antigen-binding fragment thereof that specifically binds to VISTA described herein can be generated from nucleic acid from a suitable source (e.g., a hybridoma, or a B cell from an immunized transgenic mouse) using methods well known in the art (e.g., PCR and other molecular cloning methods). For example, PCR amplification using synthetic primers hybridizable to the 3' and 5' ends of a known sequence can be performed using genomic DNA obtained from hybridoma cells or B cells producing the antibody of interest. Such PCR amplification methods can be used to obtain nucleic acids comprising the sequence encoding the light chain and/or heavy chain of an antibody or an antigen-binding fragment thereof that specifically binds to VISTA. Such PCR amplification methods can be used to obtain nucleic acids comprising the sequence encoding the variable light chain region and/or the variable heavy chain region of an antibody or an antigen-binding fragment thereof that specifically binds to VISTA. The amplified nucleic acids can be cloned into vectors for expression in host cells and for further cloning.

If a clone containing a nucleic acid sequence encoding a particular antibody is not available, but the sequence of the antibody molecule is known, a nucleic acid encoding the immunoglobulin can be chemically synthesized or obtained from a suitable source (e.g., an antibody cDNA library or a cDNA library generated from, or nucleic acid, preferably poly A+ RNA, isolated from, any tissue or cells expressing the antibody, such as, for example, hybridoma cells selected to express an antibody described herein) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR can then be cloned into replicable cloning vectors using any method well known in the art.

DNA encoding an antibody or an antigen-binding fragment thereof that specifically binds to VISTA can be readily isolated and sequenced using conventional procedures (e.g., by using oligonucleotide probes that are capable of binding specifically to genes encoding the heavy and light chains of the antibody or an antigen-binding fragment thereof that specifically binds to VISTA). Hybridoma cells or isolated B cells can serve as a source of such DNA. Once isolated, the DNA can be placed into expression vectors, which are then transfected into host cells such as, for example, *E. coli* cells, simian COS cells, Chinese hamster ovary (CHO) cells (e.g., CHO cells from the CHO GS System™ (Lonza) or the CHOZN® system (Sigma)), 293F cells, HEK293 cells, or myeloma cells that do not otherwise produce immunoglobulin protein, to obtain the synthesis of an antibody or an antigen-binding fragment thereof that specifically binds to VISTA in the recombinant host cells.

To generate whole antibodies, PCR primers including VH or VL nucleotide sequences, a restriction site, and a flanking sequence to protect the restriction site can be used to amplify the VH or VL sequences in scFv clones. Utilizing cloning techniques known to those of skill in the art, the PCR amplified VH domains can be cloned into vectors expressing a heavy chain constant region, e.g., the human gamma 1 constant region or the human gamma 4 constant region, and the PCR amplified VL domains can be cloned into vectors expressing a light chain constant region, e.g., human kappa or lambda constant regions. In certain embodiments, the vectors for expressing the VH or VL domains comprise a promoter, a secretion signal, a cloning site for the variable domain, constant domains, and a selection marker. An exemplary signal sequence that may be used in the production of an antibody or antigen-binding fragment thereof that specifically binds VISTA provided herein is MGWSCIIL-FLVATATGVHS (SEQ ID NO: 360). The VH and VL domains can also be cloned into one vector expressing the necessary constant regions. The vectors comprising the nucleotide sequences encoding the VH and/or the VL are then co-transfected into cell lines to generate stable or transient cell lines that express full-length antibodies, e.g., IgG, using techniques known to those of skill in the art.

The DNA also can be modified, for example, by substituting the coding sequence for human heavy and light chain constant domains in place of any murine or other non-human sequences, or by covalently joining to an antibody (e.g., immunoglobulin) coding sequence all or part of the coding sequence for a non-immunoglobulin polypeptide.

Also provided are polynucleotides including primers that hybridize under high stringency, intermediate or lower stringency hybridization conditions to polynucleotides that encode an antibody or an antigen-binding fragment thereof that specifically binds to VISTA described herein.

Hybridization conditions have been described in the art and are known to one of skill in the art. For example, hybridization under stringent conditions can involve hybridization to filter-bound DNA in 6×sodium chloride/sodium citrate (SSC) at about 45° C. followed by one or more washes in 0.2×SSC/0.1% SDS at about 50-65° C.; hybridization under highly stringent conditions can involve hybridization to filter-bound nucleic acid in 6×SSC at about 45° C. followed by one or more washes in 0.1×SSC/0.2% SDS at about 68° C. Hybridization under other stringent hybridization conditions are known to those of skill in the art and have been described, see, for example, Ausubel F M et al., eds., (1989) Current Protocols in Molecular Biology, Vol. I, Green Publishing Associates, Inc. and John Wiley & Sons, Inc., New York at pages 6.3.1-6.3.6 and 2.10.3.

1.4 Cells and Vectors

In certain aspects, provided herein are vectors (e.g., expression vectors) comprising polynucleotides comprising nucleotide sequences encoding an antibody or an antigen-binding fragment thereof that specifically binds to VISTA described herein for recombinant expression in host cells, preferably in mammalian cells. Expression vectors may be, e.g., plasmids or viral vectors (such as, for example, Newcastle disease virus, adenovirus, adeno-associated virus, vaccinia, etc.). Also provided herein are ex vivo host cells comprising such vectors for recombinantly expressing antibodies or antigen-binding fragments thereof that specifically binds to VISTA described herein.

Recombinant expression of antibody or an antigen-binding fragment thereof that specifically binds to VISTA described herein (e.g., a full-length antibody, heavy and/or light chain of an antibody, or a single chain antibody described herein) involves construction of an expression vector containing a polynucleotide that encodes the antibody. Once a polynucleotide encoding an antibody molecule, heavy and/or light chain of an antibody, or an antigen-binding fragment thereof (e.g., heavy and/or light chain variable regions) described herein has been obtained, the vector for the production of the antibody molecule can be produced by recombinant DNA technology using techniques well known in the art. Thus, methods for preparing a protein by expressing a polynucleotide containing an antibody or an antigen-binding fragment thereof that specifically binds to VISTA (e.g., light chain or heavy chain, or both) encoding nucleotide sequence are described herein. Methods which are well known to those skilled in the art can be used to construct expression vectors containing antibody or antibody fragment (e.g., light chain or heavy chain, or both) coding sequences and appropriate transcriptional and translational control signals. These methods include, for example, in vitro recombinant DNA techniques, synthetic techniques, and in vivo genetic recombination. Also provided are replicable vectors comprising a nucleotide sequence encoding an antibody or an antigen-binding fragment thereof that specifically binds to VISTA described herein, a heavy or light chain of an antibody or an antigen-binding fragment thereof that specifically binds to VISTA described herein, or a heavy or light chain variable domain of an antibody or an antigen-binding fragment thereof that specifically binds to VISTA described herein, operably linked to a promoter. Such vectors can, for example, include the nucleotide sequence encoding the constant region of the antibody molecule (see, e.g., International Publication Nos. WO 86/05807 and WO 89/01036; and U.S. Pat. No. 5,122,464) and variable domains of the antibody can be cloned into such a vector for expression of the entire heavy, the entire light chain, or both the entire heavy and light chains.

An expression vector can be transferred to a cell (e.g., host cell) by conventional techniques and the resulting cells can then be cultured by conventional techniques to produce an antibody or an antigen-binding fragment thereof that specifically binds to VISTA described herein. Thus, provided herein are host cells containing a polynucleotide encoding an antibody or an antigen-binding fragment thereof that specifically binds to VISTA described herein, or a heavy or light chain thereof, or a fragment thereof, or a single chain antibody or an antigen-binding fragment thereof that specifically binds to VISTA described herein, operably linked to a promoter for expression of such sequences in the host cell. The host cell can be any type of cell suitable for expression e.g., a primary cell, a cell in culture, or a cell from a cell line.

A variety of host-expression vector systems can be utilized to express antibody molecules described herein. Such host-expression systems represent vehicles by which the coding sequences of interest can be produced and subsequently purified, but also represent cells which can, when transduced or transfected with the appropriate nucleotide coding sequences, express an antibody molecule described herein in situ. These include but are not limited to microorganisms such as, for example, bacteria (e.g., *E. coli* and *B. subtilis*) transformed with recombinant bacteriophage DNA, plasmid DNA or cosmid DNA expression vectors containing antibody coding sequences; yeast (e.g., *Saccharomyces Pichia*) transformed with recombinant yeast expression vectors containing antibody coding sequences; insect cell systems infected with recombinant virus expression vectors (e.g., baculovirus) containing antibody coding sequences; plant cell systems (e.g., green algae such as, for example, *Chlamydomonas reinhardtii*) infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS (e.g., COS1 or COS), CHO, CHO GS System, CHOZN® System, BHK, MDCK, HEK 293, NS0, PER.C6, VERO, CRL7O3O, HsS78Bst, HeLa, and NIH 3T3, HEK-293T, 293F, HepG2, SP210, R1.1, B-W, L-M, BSC1, BSC40, YB/20 and BMT10 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). In specific embodiments, cells for expressing antibody or an antigen-binding fragment thereof that specifically binds to VISTA described herein are CHO cells or HEK 293 cells. In a particular embodiment, cells for expressing antibody or an antigen-binding fragment thereof that specifically binds to VISTA described herein are human cells, e.g., human cell lines. In particular embodiments, bacterial cells such as, for example, *Escherichia coli*, or eukaryotic cells (e.g., mammalian cells), especially for the expression of whole recombinant antibody molecules, are used for the expression of a recombinant antibody molecule. For example, mammalian cells such as, for example, Chinese hamster ovary (CHO) cells, in conjunction with a vector such as, for example, the major intermediate early gene promoter element from human cytomegalovirus is an effective expression system for antibodies (Foecking M K & Hofstetter H (1986) Gene 45: 101-5; and Cockett M I et al., (1990) Biotechnology 8(7): 662-7). In certain embodiments, antibodies described herein are produced by CHO cells, HEK 293 cells or NS0 cells. In specific embodiments, the expression of nucleotide sequences encoding antibody or an antigen-binding fragment thereof that specifically binds to VISTA described herein is regulated by a constitutive promoter, inducible promoter or tissue specific promoter.

In bacterial systems, a number of expression vectors can be advantageously selected depending upon the use intended for the antibody molecule being expressed. For example, when a large quantity of such an antibody is to be produced, for the generation of pharmaceutical compositions of an antibody molecule, vectors which direct the expression of high levels of fusion protein products that are readily purified can be desirable. Such vectors include, but are not limited to, the *E. coli* expression vector pUR278 (Ruether U & Mueller-Hill B (1983) EMBO J 2: 1791-1794), in which the antibody coding sequence can be ligated individually into the vector in frame with the lac Z coding region so that a fusion protein is produced; pIN vectors (Inouye S & Inouye M (1985) Nuc Acids Res 13: 3101-3109; Van Heeke G & Schuster S M (1989) J Biol Chem 24: 5503-5509); and the like. For example, pGEX vectors can also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or factor Xa protease cleavage sites so that the cloned target gene product can be released from the GST moiety.

In an insect system, *Autographa californica* nuclear polyhedrosis virus (AcNPV), for example, can be used as a vector to express foreign genes. The virus grows in *Spodoptera frugiperda* cells. The antibody coding sequence can be cloned individually into non-essential regions (for example the polyhedrin gene) of the virus and placed under control of an AcNPV promoter (for example the polyhedrin promoter).

In mammalian host cells, a number of viral-based expression systems can be utilized. In cases where an adenovirus is used as an expression vector, the antibody coding sequence of interest can be ligated to an adenovirus transcription/translation control complex, e.g., the late promoter and tripartite leader sequence. This chimeric gene can then be inserted in the adenovirus genome by in vitro or in vivo recombination. Insertion in a non-essential region of the viral genome (e.g., region E1 or E3) will result in a recombinant virus that is viable and capable of expressing the antibody molecule in infected hosts (e.g., see Logan J & Shenk T (1984) Proc.Natl. Acad. Sci USA 81(12): 3655-9). Specific initiation signals can also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression can be enhanced by the inclusion of appropriate transcription enhancer elements, transcription terminators, etc. (see, e.g., Bitter G et al., (1987) Methods Enzymol. 153: 516-544).

In addition, a host cell strain which modulates the expression of the inserted sequences, or modifies and processes the gene product in the specific fashion desired can be chosen. Such modifications (e.g., glycosylation) and processing (e.g., cleavage) of protein products can be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product can be used. Such mammalian host cells include but are not limited to CHO, VERO, BHK, Hela, MDCK, HEK 293, NIH 3T3, W138, 293F, BT483, Hs578T, HTB2, BT20 and T47D, NS0 (a murine myeloma cell line that does not endogenously produce any immunoglobulin chains), CRL7O3O, COS (e.g., COS1 or COS), PER.C6, VERO, HsS78Bst, HEK-293T, HEK293, HepG2, SP210, R1.1, B-W, L-M, BSC1, BSC40, YB/20, BMT10 and HsS78Bst cells.

In specific embodiments, the antibodies or antigen-binding fragments thereof that specifically binds to VISTA described herein have reduced fucose content or no fucose content. Such antibodies can be produced using techniques known one skilled in the art. For example, the antibodies can be expressed in cells deficient or lacking the ability of to fucosylate. In a specific example, cell lines with a knockout of both alleles of α1,6-fucosyltransferase can be used to produce antibodies or antigen-binding fragments thereof with reduced fucose content. The Potelligent® system (Lonza) is an example of such a system that can be used to produce antibodies or antigen-binding fragments thereof with reduced fucose content.

For long-term, high-yield production of recombinant proteins, stable expression cells can be generated. For example, cell lines which stably express an antibody or an antigen-binding fragment thereof that specifically binds to VISTA described herein can be engineered. In specific embodiments, a cell provided herein stably expresses a light chain/light chain variable domain and a heavy chain/heavy chain variable domain which associate to form an antibody or an antigen-binding fragment thereof that specifically binds to VISTA described herein.

In certain aspects, rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA/polynucleotide, engineered cells can be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. Such engineered cell lines can be particularly useful in screening and evaluation of compositions that interact directly or indirectly with the antibody molecule.

A number of selection systems can be used, including but not limited to, the herpes simplex virus thymidine kinase (Wigler M et al., (1977) Cell 11(1): 223-32), hypoxanthine-guanine phosphoribosyltransferase (Szybalska E H & Szybalski W (1962) PNAS 48(12): 2026-2034) and adenine phosphoribosyltransferase (Lowy I et al., (1980) Cell 22(3): 817-23) genes can be employed in tk-, hgprt- or aprt-cells, respectively. Also, antimetabolite resistance can be used as the basis of selection for the following genes: dhfr, which confers resistance to methotrexate (Wigler M et al., (1980) PNAS 77(6): 3567-70; O'Hare K et al., (1981) PNAS 78: 1527-31); gpt, which confers resistance to mycophenolic acid (Mulligan R C & Berg P (1981) PNAS 78(4): 2072-6); neo, which confers resistance to the aminoglycoside G-418 (Wu G Y & Wu $C_H$ (1991) Biotherapy 3: 87-95; Tolstoshev P (1993) Ann Rev Pharmacol Toxicol 32: 573-596; Mulligan R C (1993) Science 260: 926-932; and Morgan R A & Anderson W F (1993) Ann Rev Biochem 62: 191-217; Nabel G J & Felgner P L (1993) Trends Biotechnol 11(5): 211-5); and hygro, which confers resistance to hygromycin (Santerre R F et al., (1984) Gene 30(1-3): 147-56). Methods commonly known in the art of recombinant DNA technology can be routinely applied to select the desired recombinant clone and such methods are described, for example, in Ausubel F M et al., (eds.), Current Protocols in Molecular Biology, John Wiley & Sons, NY (1993); Kriegler M, Gene Transfer and Expression, A Laboratory Manual, Stockton Press, NY (1990); and in Chapters 12 and 13, Dracopoli N C et al., (eds.), Current Protocols in Human Genetics, John Wiley & Sons, NY (1994); Colbère-Garapin F et al., (1981) J Mol Biol 150: 1-14, which are incorporated by reference herein in their entireties.

The expression levels of an antibody molecule can be increased by vector amplification (for a review, see Bebbington C R & Hentschel C C G, The use of vectors based on gene amplification for the expression of cloned genes in mammalian cells in DNA cloning, Vol. 3 (Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse G F et al., (1983) Mol Cell Biol 3: 257-66).

The host cell can be co-transfected with two or more expression vectors described herein, the first vector encoding a heavy chain derived polypeptide and the second vector encoding a light chain derived polypeptide. The two vectors can contain identical selectable markers which enable equal expression of heavy and light chain polypeptides.

In a specific aspect, a host cell provided herein comprises a vector, wherein the vector comprises a nucleotide sequence encoding a variable light chain region (VL) of an antibody or an antigen-binding fragment thereof that specifically binds to VISTA described herein, and a nucleotide sequence encoding a variable heavy chain region (VH) of the antibody.

In another specific aspect, provided herein is an ex vivo cell containing one or more polynucleotides each comprising a nucleotide sequence encoding an antibody or an antigen-binding fragment thereof that specifically binds to VISTA described herein. In specific embodiments, an ex vivo cell contains a polynucleotide comprising a nucleotide sequence encoding the VH of an antibody or an antigen-binding fragment thereof that specifically binds to VISTA described herein, e.g., the VH of an antibody set forth in Table 7. In specific embodiments, an ex vivo cell contains a polynucleotide comprising a nucleotide sequence encoding the VL of an antibody or an antigen-binding fragment thereof that specifically binds to VISTA described herein, e.g., the VL of an antibody set forth in Table 8. In specific embodiments, an ex vivo cell contains a first polynucleotide comprising a nucleotide sequence encoding the VH of an antibody or an antigen-binding fragment thereof that specifically binds to VISTA described herein, e.g., the VH of an antibody set forth in Table 7 and a second polynucleotide comprising a nucleotide sequence encoding the VL of the same antibody or antigen-binding fragment thereof as set forth in Table 8.

Alternatively, a single vector can be used which encodes, and is capable of expressing, both heavy and light chain polypeptides of an antibody or an antigen-binding fragment thereof that specifically binds to VISTA described herein. In such an expression vector, the transcription of both genes can be driven by a common promoter, whereas the translation of the mRNA from the first gene can be by a cap-dependent scanning mechanism and the translation of the mRNA from the second gene can be by a cap-independent mechanism, e.g., by an IRES.

In another specific aspect, provided herein is an ex vivo cell containing one or more polynucleotides, each comprising a nucleotide sequence encoding the light and/or heavy chain of an antibody or an antigen-binding fragment thereof that specifically binds to VISTA described herein. In specific embodiments, an ex vivo cell contains a polynucleotide comprising a nucleotide sequence set forth in Table 12. In specific embodiments, an ex vivo cell contains a polynucleotide comprising a nucleotide sequence set forth in Table 13. In specific embodiments, an ex vivo cell contains a first polynucleotide comprising a nucleotide sequence set forth in Table 12 which encodes the heavy chain of an antibody, and a second polynucleotide comprising a nucleotide sequence set forth in Table 13 encoding the light chain of the same antibody. In a specific embodiment, a host cell (e.g., an ex vivo host cell) described herein is cultured under conditions to produce the antibody or antigen-binding fragment thereof encoded by the polynucleotide sequence contained in the host cell using a technique known in the art. In certain embodiments, the antibody or antigen-binding fragment thereof is isolated or purified from the host cell using a technique known in the art.

1.5 Pharmaceutical Compositions

Provided herein are pharmaceutical compositions comprising (a) an antibody or an antigen-binding fragment thereof that specifically binds to VISTA described herein and (b) a pharmaceutically acceptable carrier. In a specific embodiment, the antibody or antigen-binding fragment thereof is purified. In a specific embodiment, the antibody or antigen-binding fragment thereof is present in the pharmaceutical composition in a therapeutically effective amount.

In a specific embodiment, the antibody or antigen-binding fragment thereof is purified.

Also provided herein are pharmaceutical compositions comprising a polynucleotide or vector(s) described herein and a pharmaceutically acceptable carrier.

Also provided herein are pharmaceutical compositions comprising (a) an antibody-drug conjugate described herein (e.g., comprising an antibody or an antigen-binding fragment thereof that specifically binds to VISTA described herein bound to a therapeutic agent) and (b) a pharmaceutically acceptable carrier. In a specific embodiment, the antibody-drug conjugate is present in the pharmaceutical composition in a therapeutically effective amount.

Also provided herein are pharmaceutical compositions comprising (a) a bispecific antibody or a multispecific antibody that binds to VISTA and another antigen of interest (e.g., as described herein) and (b) a pharmaceutically acceptable carrier. In a specific embodiment, the bispecific antibody is purified. In a specific embodiment, the bispecific antibody is present in the pharmaceutical composition in a therapeutically effective amount.

Also provided herein are pharmaceutical compositions comprising (a) a cell expressing a CAR comprising an scFv comprising the VH and VL of an antibody or an antigen-binding fragment thereof that specifically binds to VISTA described herein and (b) a pharmaceutically acceptable carrier.

Acceptable carriers, which can be excipients or stabilizers, are nontoxic to recipients at the dosages and concentrations employed, and include but are not limited to buffers such as, for example, phosphate, citrate, and other organic acids; antioxidants including ascorbic acid and methionine; preservatives (such as, for example, octadecyldimethylbenzyl ammonium chloride; hexamethonium chloride; benzalkonium chloride, benzethonium chloride; phenol, butyl or benzyl alcohol; alkyl parabens such as, for example, methyl or propyl paraben; catechol; resorcinol; cyclohexanol; 3-pentanol; and m-cresol); low molecular weight (less than about 10 residues) polypeptides; proteins, such as, for example, serum albumin, gelatin, or immunoglobulins; hydrophilic polymers such as, for example, polyvinylpyrrolidone; amino acids such as, for example, glycine, glutamine, asparagine, histidine, arginine, or lysine; monosaccharides, disaccharides, and other carbohydrates including glucose, mannose, or dextrins; chelating agents such as, for example, EDTA; sugars such as, for example, sucrose, mannitol, trehalose or sorbitol; salt-forming counter-ions such as, for example, sodium; metal complexes (e.g., Zn-protein complexes); and/or non-ionic surfactants such as, for example, TWEEN™, PLURONICS™ or polyethylene glycol (PEG).

In a specific embodiment, pharmaceutical compositions comprise an antibody or an antigen-binding fragment thereof that specifically binds to VISTA described herein, and optionally one or more additional prophylactic or therapeutic agents, in a pharmaceutically acceptable carrier. In a specific embodiment, pharmaceutical compositions comprise an effective amount of an antibody or an antigen-binding fragment thereof that specifically binds to VISTA described herein, and optionally one or more additional prophylactic or therapeutic agents, in a pharmaceutically acceptable carrier. In a specific embodiment, the pharmaceutical compositions and/or antibodies or antigen-binding fragments thereof described herein, can be combined with a therapeutically effective amount of an additional therapeutic agent.

In a specific embodiment, pharmaceutical compositions comprise an antibody-drug conjugate described herein, and optionally one or more additional prophylactic or therapeutic agents, in a pharmaceutically acceptable carrier. In a specific embodiment, pharmaceutical compositions comprise an effective amount of an antibody-drug conjugate described herein, and optionally one or more additional prophylactic or therapeutic agents, in a pharmaceutically acceptable carrier. In a specific embodiment, the pharmaceutical compositions and/or antibody-drug conjugate described herein, can be combined with a therapeutically effective amount of an additional therapeutic agent.

In specific embodiments, the antibody or an antigen-binding fragment thereof that specifically binds to VISTA is the only active ingredient included in the pharmaceutical composition. In specific embodiments, a polynucleotide(s) or a vector(s) encoding an antibody or an antigen-binding fragment thereof is the only active ingredient in the pharmaceutical composition.

Pharmaceutical compositions described herein can be used to treat cancer, auto-immune diseases, and infections, e.g., bacterial and fungal infections.

Pharmaceutical compositions may be formulated for any route of administration (e.g., parenteral, topical, intratumoral, etc.).

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcelluose, hydroxypropyl methylcellulose and polyvinylpyrrolidone. Emulsifying agents include Polysorbate 80 (TWEEN® 80). A sequestering or chelating agent of metal ions includes EDTA. Pharmaceutical carriers also include ethyl alcohol, polyethylene glycol and propylene glycol for water miscible vehicles, and sodium hydroxide, hydrochloric acid, citric acid or lactic acid for pH adjustment.

A pharmaceutical composition may be formulated for any route of administration to a subject. Specific examples of routes of administration include intranasal, oral, pulmonary, transdermal, intradermal, intravesical and parenteral. In some embodiments, the administration is intratumoral. Parenteral administration, characterized by either subcutaneous, intramuscular or intravenous injection, is also contemplated herein. Injectables can be prepared in conventional forms, either as liquid solutions or suspensions, solid forms suitable for solution or suspension in liquid prior to injection, or as emulsions. The injectables, solutions and emulsions also contain one or more excipients. Suitable excipients are, for example, water, saline, dextrose, glycerol or ethanol. In addition, if desired, the pharmaceutical compositions to be administered can also contain minor amounts of non-toxic auxiliary substances such as, for example, wetting or emulsifying agents, pH buffering agents, stabilizers, solubility enhancers, and other such agents, such as for example, sodium acetate, sorbitan monolaurate, triethanolamine oleate and cyclodextrins.

Preparations for parenteral administration of an antibody include sterile solutions ready for injection, sterile dry soluble products, such as, for example, lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous.

If administered intravenously, suitable carriers include physiological saline or phosphate buffered saline (PBS), and solutions containing thickening and solubilizing agents, such as, for example, glucose, polyethylene glycol, and polypropylene glycol and mixtures thereof.

Topical mixtures comprising an antibody are prepared as described for the local and systemic administration. The resulting mixture can be a solution, suspension, emulsions or the like and can be formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

An antibody or an antigen-binding fragment thereof that specifically binds to VISTA described herein, or an antibody-drug conjugate described herein, can be formulated as an aerosol for topical application, such as, for example, by inhalation (see, e.g., U.S. Pat. Nos. 4,044,126, 4,414,209 and 4,364,923, which describe aerosols for delivery of a steroid useful for treatment of inflammatory diseases, particularly asthma). These formulations for administration to the respiratory tract can be in the form of an aerosol or solution for a nebulizer, or as a microfine powder for insufflations, alone or in combination with an inert carrier such as, for example, lactose. In such a case, the particles of the formulation will, in one embodiment, have diameters of less than 50 microns, in one embodiment less than 10 microns.

An antibody or an antigen-binding fragment thereof that specifically binds to VISTA described herein, or an antibody-drug-conjugate described herein, can be formulated for local or topical application, such as, for example, for topical application to the skin and mucous membranes, such as, for example, in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the antibody alone or in combination with other pharmaceutically acceptable excipients can also be administered.

Transdermal patches, including iontophoretic and electrophoretic devices, are well known to those of skill in the art, and can be used to administer an antibody. For example, such patches are disclosed in U.S. Pat. Nos. 6,267,983, 6,261,595, 6,256,533, 6,167,301, 6,024,975, 6,010715, 5,985,317, 5,983,134, 5,948,433, and 5,860,957.

In certain embodiments, a pharmaceutical composition comprising an antibody or an antigen-binding fragment thereof that specifically binds to VISTA described herein, or an antibody-drug conjugate described herein, is a lyophilized powder, which can be reconstituted for administration as solutions, emulsions and other mixtures. It may also be reconstituted and formulated as solids or gels. The lyophilized powder is prepared by dissolving an antibody or an antigen-binding fragment thereof that specifically binds to VISTA described herein, or an antibody-drug conjugate described herein, or a pharmaceutically acceptable derivative thereof, in a suitable solvent. In specific embodiments, the lyophilized powder is sterile. The solvent may contain an excipient which improves the stability or other pharmacological component of the powder or reconstituted solution, prepared from the powder. Excipients that may be used include, but are not limited to, dextrose, sorbitol, fructose, corn syrup, xylitol, glycerin, glucose, sucrose or other suitable agent. The solvent may also contain a buffer, such as, for example, citrate, sodium or potassium phosphate or other such buffer known to those of skill in the art at, in one embodiment, about neutral pH. Subsequent sterile filtration of the solution followed by lyophilization under standard conditions known to those of skill in the art provides the desired formulation. In one embodiment, the resulting solution will be apportioned into vials for lyophilization. Each vial will contain a single dosage or multiple dosages of the compound. The lyophilized powder can be stored under appropriate conditions, such as, for example, at about 4° C. to room temperature.

Reconstitution of this lyophilized powder with water for injection provides a formulation for use in parenteral administration. For reconstitution, the lyophilized powder is added to sterile water or other suitable carrier. The precise amount depends upon the selected compound. Such amount can be empirically determined.

In specific embodiments, pharmaceutical compositions comprising an antibody or an antigen-binding fragment thereof that specifically binds to VISTA described herein, or an antibody-drug conjugate described herein, are supplied in liquid form without the need to reconstitute.

The antibodies or antigen-binding fragments thereof that specifically binds to VISTA described herein, or antibody-drug conjugates described herein and other compositions provided herein can also be formulated to be targeted to a particular tissue, receptor, or other area of the body of the subject to be treated. Many such targeting methods are well known to those of skill in the art. All such targeting methods are contemplated herein for use in the instant compositions. For non-limiting examples of targeting methods, see, e.g., U.S. Pat. Nos. 6,316,652, 6,274,552, 6,271,359, 6,253,872, 6,139,865, 6,131,570, 6,120,751, 6,071,495, 6,060,082, 6,048,736, 6,039,975, 6,004,534, 5,985,307, 5,972,366, 5,900,252, 5,840,674, 5,759,542 and 5,709,874. In a specific embodiment, an antibody or an antigen-binding fragment thereof that specifically binds to VISTA described herein, or an antibody-drug conjugate described herein, is targeted to a tumor.

The compositions to be used for in vivo administration can be sterile. This is readily accomplished by filtration through, e.g., sterile filtration membranes.

1.6 Methods of Treatment

In one aspect, presented herein are methods for treating cancer in a subject, comprising administering to a subject in need thereof an antibody or an antigen-binding fragment thereof that specifically binds to VISTA described herein, or a pharmaceutical composition comprising an antibody or an antigen-binding fragment thereof that specifically binds to VISTA described herein. In another aspect, presented herein are methods for treating cancer in a subject, comprising administering to a subject in need thereof an antibody-drug conjugate described herein (e.g., comprising an antibody or an antigen-binding fragment thereof that specifically binds to VISTA described herein bound to a therapeutic agent), or a pharmaceutical composition comprising an antibody-drug conjugate described herein. In another aspect, presented herein are methods for treating cancer in a subject, comprising administering to a subject in need thereof a cell expressing a CAR described herein or a pharmaceutical composition comprising a cell expressing a CAR described herein.

In a specific embodiment, presented herein are methods for treating cancer in a subject, comprising administering to a subject in need thereof a bispecific antibody described herein, or a pharmaceutical composition comprising a bispecific or multispecific antibody described herein. In another aspect, presented herein are methods for treating cancer in a subject, comprising administering to a subject in need thereof a cell expressing a CAR described herein, or a pharmaceutical composition comprising a cell expressing a CAR described herein. In another aspect, presented herein are methods for treating cancer in a subject, comprising administering to a subject in need thereof a polynucleotide or vector encoding an antibody or an antigen-binding fragment thereof that specifically binds to VISTA described herein, or a pharmaceutical composition comprising a polynucleotide(s) or vector(s) encoding an antibody or an antigen-binding fragment thereof that specifically binds to VISTA described herein.

In specific embodiments, the subject is a mammal such as, for example, a primate (e.g., monkey or human). In a specific embodiment, the subject is a human. As used herein, the terms "subject" and "patient" are used interchangeably.

In specific embodiments, the cancer being treated is non-small cell lung cancer, small cell lung cancer, head and neck squamous cell carcinoma, hepatocellular carcinoma, ovarian cancer, neuroblastoma, oral cancer, thyroid cancer, breast cancer, a sarcoma, pancreatic cancer, colon cancer, gastric cancer, choriocarcinoma, testicular cancer, mesothelioma, skin cancer, renal cell carcinoma, bladder cancer, or cervical cancer. In specific embodiments, the cancer is a hematological cancer. In specific embodiments, the cancer is a leukemia (e.g., acute myeloid leukemia). In specific embodiments, the cancer is a lymphoma. The cancer can be a solid tumor or non-solid tumor. In specific embodiments, the cancer is metastatic.

In specific embodiments, the cancer being treated is a "cold tumor" (i.e., a tumor that has a low level of infiltration by T cells, similar to the level generally seen in pancreatic malignant tumors), e.g., a prostate, breast, ovarian, bladder, or pancreatic tumor, colorectal cancer (CRC), head and neck squamous cell carcinoma (HNSCC), small cell lung cancer, or a glioblastoma. In specific embodiments, the cancer is a cold tumor that has high expression of VISTA compared to, e.g., a healthy tissue control, for example, a noncancerous cell sample of the same tissue or organ type as the cancer.

In a specific embodiment, the cancer being treated is a VISTA-positive cancer, i.e., it expresses detectable levels of VISTA.

In certain embodiments, the methods for treating cancer described herein comprise, prior to the administering step, a step of obtaining a tumor biopsy, tumor sample, or cancer cell sample from the subject and assessing the level of expression of VISTA using an assay described herein or known to one of skill in the art. Techniques known to one of skill in the art may be used to obtain a tumor biopsy or cancer cell sample. In specific embodiments, immuno-histochemistry (IHC), a Western blot, an ELISA or flow cytometry is used to assess VISTA expression levels. In specific embodiments, a subject treated in accordance with the methods described herein has a tumor showing detectable, e.g., high VISTA expression, e.g., a tumor showing high VISTA expression compared to, e.g., a healthy tissue control, for example, a noncancerous cell sample of the same tissue or organ type as the cancer.

In specific embodiments, the administration of an antibody or an antigen-binding fragment thereof that specifically binds to VISTA described herein, or an antibody-drug conjugate described herein, or cell expressing a CAR described herein, or a pharmaceutical composition described herein, to a subject with cancer achieves at least one, two, three, four or more of the following effects: (i) the reduction or amelioration of the severity of one or more symptoms of cancer; (ii) the reduction in the duration of one or more symptoms associated with cancer; (iii) the prevention in the recurrence of a symptom associated with cancer; (iv) the reduction in hospitalization of a subject; (v) a reduction in hospitalization length; (vi) the increase in the survival of a subject; (vii) the enhancement or improvement of the therapeutic effect of another therapy; (viii) the inhibition of the development or onset of one or more symptoms associated with cancer; (ix) the reduction in the number of symptoms associated with cancer; (x) improvement in quality of life as assessed by a method well known in the art; (x) inhibition of the recurrence of a tumor; (xi) the regression of a tumor and/or one or more symptoms associated therewith; (xii) the inhibition of the progression of a tumor and/or one or more symptoms associated therewith; (xiii) a reduction in the growth of a tumor; (xiv) a decrease in tumor size (e.g., volume or diameter); (xv) a reduction in the formation of a newly formed tumor; (xvi) eradication, removal, or control of primary, regional and/or a metastatic tumor; (xvii) a prevention or decrease in the number or size of metastases; (xviii) a reduction in mortality; (xix) an increase in relapse free survival; (xx) the size of the tumor is maintained and does not increase or increases by less than the increase of a tumor after administration of a standard therapy as measured by a conventional method available to one of skill in the art, such as, for example, magnetic resonance imaging (MRI), dynamic contrast-enhanced MRI (DCE-MRI), X-ray, and computed tomography (CT) scan, or a positron emission tomography (PET) scan; and/or (xxi) an increase in the length of remission in the subject.

In specific embodiments, a method of treating cancer as described herein results in one, two, three or more of the following effects: complete response, partial response, objective response, increase in overall survival, increase in disease free survival, increase in objective response rate, increase in time to progression, stable disease, increase in progression-free survival, increase in time-to-treatment failure, and improvement or elimination of one or more symptoms of cancer. In a specific embodiment, a method of treating cancer as described herein results in an increase in overall survival. In another specific embodiment, a method of treating cancer as described herein results in an increase in progression-free survival. In another specific embodiment, a method of treating cancer as described herein results in an increase in overall survival and an increase in progression-free survival.

In a specific embodiment, complete response has the meaning understood by one of skill in the art. In a specific embodiment, complete response refers to the disappearance of all signs of cancer in response to treatment. A complete response may not mean that the cancer is cured but that patient is in remission. In a specific embodiment, a cancer is in complete remission if disease is not detected by known techniques such as, for example, radiographic studies, bone marrow, and biopsy or protein measurements.

In a specific embodiment, partial response has the meaning understood by one of skill in the art. For example, a partial response may refer to a decrease in the size of a tumor in the human body in response to the treatment. In a specific embodiment, a partial response refers to at least about a 10%, 20%, 30%, 40%, 50%, 60%, 70%, 80%, or 90% decrease in all measurable tumor burden (e.g., the number of malignant cells present in the subject, or the measured bulk of tumor masses or the quantity of abnormal monoclonal protein) in the absence of new lesions.

In a specific embodiment, overall survival has the meaning understood by one of skill in the art. In a specific embodiment, overall survival refers to the length of time from either the date of the diagnosis or the start of treatment. Demonstration of a statistically significant improvement in overall survival can be considered to be clinically significant if the toxicity profile is acceptable, and has often supported new drug approval.

Several endpoints are typically based on tumor assessments. These endpoints include disease free survival (DFS), objective response rate (ORR), time to progression (TTP), progression-free survival (PFS), and time-to-treatment failure (TTF). The collection and analysis of data on these time-dependent endpoints are often based on indirect assessments, calculations, and estimates (e.g., tumor measurements).

In a specific embodiment, disease free survival (DFS) has the meaning understood by one of skill in the art. In a specific embodiment, disease-free survival may refer to the length of time after primary treatment for the cancer ends that the human subject survives without any signs or symptoms of cancer. DFS can be an important endpoint in situations where survival may be prolonged, making a survival endpoint impractical. DFS can be a surrogate for clinical benefit or it can provide direct evidence of clinical benefit. This determination is typically based on the magnitude of the effect, its risk-benefit relationship, and the disease setting. The definition of DFS can be complicated, particularly when deaths are noted without prior tumor progression documentation. These events may be scored either as disease recurrences or as censored events. Although all methods for statistical analysis of deaths have some limitations, considering all deaths (deaths from all causes) as recurrences can minimize bias. DFS can be overestimated using this definition, especially in patients who die after a long period without observation. Bias can be introduced if the frequency of long-term follow-up visits is dissimilar between the study arms or if dropouts are not random because of toxicity.

In a specific embodiment, objective response rate has the meaning understood by one of skill in the art. In one embodiment, an objective response rate is defined as the proportion of patients with tumor size reduction of a predefined amount and for a minimum time period. Response duration maybe measured from the time of initial response until documented tumor progression. Generally, the FDA has defined ORR as the sum of partial responses plus complete responses. When defined in this manner, ORR is a direct measure of drug antitumor activity, which can be evaluated in a single-arm study. If available, standardized criteria should be used to ascertain response. A variety of response criteria have been considered appropriate (e.g., RECIST1.1 criteria) (See e.g., Eisenhower et al., 2009, European J. of Cancer, 45: 228-247)). The significance of ORR is assessed by its magnitude and duration, and the percentage of complete responses (no detectable evidence of tumor).

In a specific embodiment, time to progression (TTP) has the meaning understood by one of skill in the art. In a specific embodiment, time to progression refers to the length of time from the date of diagnosis or start of treatment for a cancer until the cancer gets worse or spreads to other parts of the human body.

In a specific embodiment, TTP is the time from randomization until objective tumor progression; TTP does not include deaths.

In a specific embodiment, progression free survival (PFS) has the meaning understood by one of skill in the art. In a specific embodiment, PFS refers to the length of time during and after treatment of a cancer that the human patient lives with the cancer but it does not get worse. In a specific embodiment, PFS is defined as the time from randomization until objective tumor progression or death. PFS may include deaths and thus can be a better correlate to overall survival.

In a specific embodiment, time-to-treatment failure (TTF) has the meaning understood by one of skill in the art. In a specific embodiment, TTF is composite endpoint measuring time from randomization to discontinuation of treatment for any reason, including disease progression, treatment toxicity, and death.

In a specific embodiment, the RECIST 1.1 criteria is used to measure how well a human subject responds to the treatment methods described herein.

In specific embodiments, the efficacy of treatment in accordance with the methods described herein can be evaluated using biomarkers. Indicators of efficacy include, for example, an increase in frequency of myeloid dendritic cells (mDC) and/or an increase in monocyte and/or dendritic cell activation, and/or an increase in CD80, CD86 and/or HLA-DR. Indicators of efficacy can also include, in specific embodiments, an increase or decrease in one or more specific immune cell populations, chemokine levels, or cytokine levels, or VISTA expression as measured in the blood of a patient or in a tumor biopsy. In specific embodiments, an increase in CXCL10, MIP1β (CCL2) and/or MCP-1 (CCL4) is used to measure treatment efficacy.

In specific embodiments, the subject treated in accordance with the methods described herein has undergone chemotherapy and/or radiation therapy prior to receiving an antibody or an antigen-binding fragment thereof that specifically binds to VISTA described herein. In specific embodiments, the subject treated in accordance with the methods described herein has undergone therapy with an immune checkpoint inhibitor such as, for example, an inhibitor of Programmed Death-1 (PD-1) or Programmed death-ligand 1 (PDL1) or an inhibitor of cytotoxic T-lymphocyte-associated protein 4 (CTLA-4) prior to receiving an antibody or an antigen-binding fragment thereof that specifically binds to VISTA described herein. In specific embodiments, a subject treated in accordance with the methods described herein has failed two or more therapies for the treatment of the cancer of the subject, e.g., the cancer is resistant to two or more therapies. In specific embodiments, a subject treated in accordance with the methods described herein has a cancer that is resistant to one or more other therapies for treatment of the cancer; such other cancer therapies can be, for example, surgery, radiation, chemotherapy, and targeted therapy.

In specific embodiments, the tumor treated in accordance with the methods described herein is refractory to surgery, radiation therapy and/or chemotherapy. In specific embodiments, the tumor treated in accordance with the methods described herein is refractory to treatment with an immune checkpoint inhibitor (e.g., a PDL1 inhibitor such as, for example, atezolizumab, a PD-1 inhibitor such as, for example, pembrolizumab, or a CTLA-4 inhibitor such as, for example, ipilimumab). In specific embodiments, the tumor treated in accordance with the methods described herein is refractory to radiation therapy and/or chemotherapy, and is also refractory to an immune checkpoint inhibitor (e.g., a PDL1 inhibitor, a CTLA-4 inhibitor such as, for example, ipilimumab, or an anti-PD-1 inhibitor such as, for example, pembrolizumab). In specific embodiments, the tumor treated in accordance with the methods described herein is refractory to treatment with a tyrosine kinase inhibitor (e.g., sorafenib).

In specific embodiments, the tumor treated in accordance with the methods described herein is refractory to treatment with targeted therapy (e.g. a HER-2 inhibitor such as, for example, trastuzumab; a HER3 inhibitor; a VEGF inhibitor such as, for example, bevacizumab; a BRAF inhibitor such as, for example, vemurafenib; a BCR-ABL fusion protein inhibitor such as, for example, imatinib mesylate; a signal transduction inhibitor such as, for example, a MAP kinase inhibitor, a MEK inhibitor, a TGFβ inhibitor, an EGFR inhibitor, an mTOR inhibitor, a farnesyl transferase inhibitor, or a glutathione S transferase inhibitor; or an apoptosis inducer). In specific embodiments, the tumor treated in accordance with the methods described herein is refractory to treatment with hormone therapy (e.g. abiraterone, anastrozole, exemestane, fluvestrant, letrozole, leuprolide or tamoxifen).

Routes of Administration and Dosage

An antibody or an antigen-binding fragment thereof that specifically binds to VISTA described herein, or an antibody-drug conjugate described herein, or a pharmaceutical composition described herein may be delivered to a subject by a variety of routes. These include, but are not limited to, parenteral, intranasal, intratracheal, oral, intradermal, topical, intramuscular, intraperitoneal, intravesical, transdermal, intravenous, conjunctival, and subcutaneous routes. In a specific embodiment, the administration is intratumoral.

Pulmonary administration can also be employed, e.g., by use of an inhaler or nebulizer, and formulation with an aerosolizing agent for use as a spray. In one embodiment, an antibody or an antigen-binding fragment thereof that specifically binds to VISTA described herein, or an antibody-drug conjugate described herein, or a pharmaceutical composition described herein is administered parenterally to a subject. In a specific embodiment, said parenteral administration is intravenous, intramuscular, or subcutaneous. In a specific embodiment, intravenous administration is used.

The amount of an antibody or an antigen-binding fragment thereof that specifically binds to VISTA described herein, or an antibody-drug conjugate, or a cell expressing a CAR described herein, or pharmaceutical composition which will be effective in the treatment of a condition will depend on the nature of the disease, and can be determined by standard clinical techniques.

The precise dose of an antibody or an antigen-binding fragment thereof that specifically binds to VISTA, or an antibody-drug conjugate, or a cell expressing a CAR described herein to be employed in a pharmaceutical composition will also depend on the route of administration, and the type of cancer, and should be decided according to the judgment of the practitioner and each subject's circumstances. For example, effective doses may also vary depending upon means of administration, target site, physiological state of the patient (including age, sex, body weight and health), whether the patient is human or animal, other medications administered, or whether treatment is prophylactic or therapeutic.

In certain embodiments, an in vitro assay is employed to help identify optimal dosage ranges. Effective doses may be extrapolated from dose response curves derived from in vitro or animal model test systems.

For an antibody (or an antigen-binding fragment thereof) or an antibody drug conjugates, typically the dosage ranges from about 0.0001 to 100 mg/kg, and more usually 0.01 to 15 mg/kg, of the patient body weight. For example, dosages can be 1 mg/kg body weight, 10 mg/kg body weight, 30 mg/kg body weight or within the range of 1 to 30 mg/kg or in other words, 80 mg or 2400 mg or within the range of 80-2400 mg, respectively, for a 80 kg patient. In specific embodiments, the dosage administered to the patient is about 1 mg/kg to about 30 mg/kg of the patient's body weight. In specific embodiments, the dosage administered to the patient is about 1 mg/kg to about 3 mg/kg of the patient's body weight. Alternatively, the dosage used in the methods of treatment disclosed herein in a specific embodiment is in the range of 1 to 500 mg, e.g., 10 to 400 mg, 30 to 300 mg, 100 to 300 mg, 200 mg to 1 g, or 1 g to 3 g e.g. once weekly, every two weeks or every three weeks, for a human patient. In specific embodiments, an immunoglobulin antibody that specifically binds to VISTA provided herein is administered to a human subject at a dose of 3 mg, 10 mg, 30 mg, 100 mg, or 300 mg, or in the range of 100 to 300 mg, 100 mg to 1 g, 200 mg to 1 g, or 1 g to 3 g, once weekly, every two weeks or every three weeks. Dosing based on body weight may be preferable in a pediatric patient (e.g., a patient under 18 years of age), whereas in an adult patient, a fixed dose may be preferable.

In specific embodiments, an above-described regimen is used to treat a patient with an advanced solid tumor. In specific embodiments, an above-described regimen is used to treat a patient with metastatic or recurrent non-small cell lung cancer (NSCLC). In specific embodiments, an above-described regimen is used to treat a patient with metastatic or recurrent head and neck squamous cell carcinoma (HNSCC). In specific embodiments, an above-described regimen is used to treat a patient (e.g., with NSCLC or HNSCC) who has failed chemotherapy including for example tyrosine kinase inhibitor therapy, e.g., the cancer is resistant to the chemotherapy. In specific embodiments, an above-described regimen is used to treat a patient (e.g., with NSCLC or HNSCC) who has failed radiation therapy in combination with therapy with an inhibitor of PD-1 or PDL1, e.g., the cancer is resistant to radiation therapy in combination with therapy with an inhibitor of PD-1 or PLDL1. In specific embodiments, an above-described regimen is used to treat a patient (e.g., with NSCLC or HNSCC) who has failed chemotherapy in combination with radiation therapy and therapy with an inhibitor of PD-1 or PDL1, e.g., the cancer is resistant to chemotherapy in combination with radiation therapy and therapy with an inhibitor of PD-1 or PDL1.

In specific embodiments, an above-described regimen is used to treat a patient with recurrent or progressive ovarian or cervical cancer who has failed platinum-containing systemic chemotherapy, e.g., the cancer is resistant to platinum-containing systemic chemotherapy. In specific embodiments, an above-described regimen is used to treat a patient with recurrent or progressive pancreatic cancer who has failed one or more of surgical resection, radiation therapy, 5-fluorouracil (5-FU), capecitabine, gemcitabine, cisplatin, oxaliplatin, irinotecan, leucovorin and paclitaxel, e.g., the cancer is resistant to one or more of surgical resection, radiation therapy, 5-fluorouracil (5-FU), capecitabine, gemcitabine, cisplatin, oxaliplatin, irinotecan, leucovorin and paclitaxel. In specific embodiments, an above-described regimen is used to treat a patient with recurrent or progressive breast cancer who has failed one or more of surgical resection, radiation therapy, chemotherapy (docetaxel, paclitaxel, cyclophosphamide, 5-FU, capecitabine, gemcitabine, doxorubicin, mitoxantrone, carboplatin, platinum), hormone therapy (tamoxifen, exemestane, anastrozole, letrozole, fulvestrant), targeted therapy (trastuzumab, lapatinib, pertuzumab, abemaciclib, Palbociclib, ribociclib, alpelisib, neratinib, Olaparib, talazoparib) and immune therapy (atezolizumab), e.g., the cancer is resistant to one or more of surgical resection, radiation therapy, chemotherapy (docetaxel, paclitaxel, cyclophosphamide, 5-FU, capecitabine, gemcitabine, doxorubicin, mitoxantrone, carboplatin, platinum), hormone therapy (tamoxifen, exemestane, anastrozole, letrozole, fulvestrant), targeted therapy (trastuzumab, lapatinib, pertuzumab, abemaciclib, Palbociclib, ribociclib, alpelisib, neratinib, Olaparib, talazoparib) and immune therapy (atezolizumab). In specific embodiments, an above-described regimen is used to treat a patient with recurrent or progressive prostate cancer who has failed one or more of surgical resection, radiation therapy, hormone therapy (busarelin, degarelix, goserelin, histrelin, leuprolide, relugolix, triptorelin, bicalutamide, flutamide, nilutamide, abiraterone, apalutamide, enzalutamide), chemotherapy (docetaxel) and immune therapy (sipuleucel-T), e.g., the cancer is resistant to one or more of surgical resection, radiation therapy, hormone therapy (busarelin, degarelix, goserelin, histrelin, leuprolide, relugolix, triptorelin, bicalutamide, flutamide, nilutamide, abiraterone, apalutamide, enzalutamide), chemotherapy (docetaxel) and immune therapy (sipuleucel-T). In specific embodiments, an above-described regimen is used to treat a patient with recurrent or progressive colorectal cancer who has failed one or more of surgical resection, radiation therapy, chemotherapy (5-FU, leucovorin, oxaliplatin, capecitabine, irinotecan), and targeted therapy (bevacizumab, ziv-afilbercept, ramucirumab, cetuximab or panitumumab), e.g., the cancer is resistant to one or more of surgical resection, radiation therapy, chemotherapy (5-FU, leucovorin, oxaliplatin, capecitabine, irinotecan), and targeted therapy (bevacizumab, ziv-afilbercept, ramucirumab, cetuximab or panitumumab). In specific embodiments, an above-described regimen is used to treat a patient with recurrent or progressive gastric or gastroesophageal cancer who has failed one or more of surgical resection, radiation therapy, 5-FU, epirubicin, cisplatin, oxaliplatin, docetaxel, capecitabine, etoposide, methotrexate, leucovorin, trastuzumab, nivolumab and pembrolizumab, e.g., the cancer is resistant to one or more of surgical resection, radiation therapy, 5-FU, epirubicin, cisplatin, oxaliplatin, docetaxel, capecitabine, etoposide, methotrexate, leucovorin, trastuzumab, nivolumab and pembrolizumab. In specific embodiments, an above-described regimen is used to treat a patient with renal cell carcinoma, head and neck cancer, or lung cancer.

An exemplary treatment regime entails administration once per every week, every two weeks, or every three weeks or once a month or once every 3 to 6 months for a period of one year or over several years, or over several year-intervals. In some methods, two or more antibodies or antigen-binding fragments thereof with different binding specificities are administered simultaneously to a subject. An antibody or an antigen-binding fragment thereof that specifically binds to VISTA, or an antibody-drug conjugate is usually administered on multiple occasions. Dosages can be given, for example, daily, twice a week, three times a week, weekly, every 2 weeks, every 3 weeks, monthly, every 3 months, every 6 months or yearly. In specific embodiments, an antibody or an antigen-binding fragment thereof that specifically binds to VISTA provided herein, or an antibody-drug conjugate provided herein, is administered once every 3 weeks.

Combination Therapies

In a specific aspect, the methods for treating cancer described herein further comprise administering to the subject an additional therapy, e.g., for treating the cancer. In a specific embodiment, the additional therapy is one additional therapy; alternatively, in a specific embodiment, the method for treating cancer comprises administering more than one additional therapy. The additional therapy(ies) can be anti-cancer therapies selected from the group consisting of surgery, radiation, chemotherapy, targeted therapy or other therapeutic agent, or a combination thereof. In specific embodiments, the additional therapy is for treating the cancer. In specific embodiments, the additional therapy is for treating any side effects of treatment with an antibody or an antigen-binding fragment thereof that specifically binds to VISTA, or an antibody-drug conjugate, or cell expressing a CAR described herein. In specific embodiments, the additional therapy increases the efficacy of an antibody or antigen-binding fragment thereof that specifically binds to VISTA provided herein. In some embodiments, the additional therapy is an immune cell therapy, e.g., dendritic cells or TILs.

In specific embodiments, the additional therapy is a therapy for treating the cancer that is a chemotherapeutic agent or a targeted therapy, e.g., a tyrosine kinase inhibitor. In specific embodiments, the additional therapy is an immune checkpoint inhibitor. In specific embodiments, the additional therapy is an agonist of B7H7, OX40, CD27, CD70, CD137 (4-1BB), CD137L, CD40, OX40L, CD160, GITR, GITR-L, ICOS, ICOSL, CD80, or CD86. In specific embodiments, the additional therapy is an antagonist of CTLA4, PD1, PD-L1, PD-L2, LAG-3, TIM-3, B7H3, B7H4, B7H6, BTLA, TIGIT, LAIR1, 2B4 (CD244), CD47, SIRPα, ILT4, TGFβ, TGFβ-R, VSIG3, VSIG8, LRIG1, PSGL1, CEACAM, HVEM, Galectin-9, or FLG-1.

In a specific embodiment, a method for treating cancer described herein comprising administering an antibody or an antigen-binding fragment thereof that specifically binds to VISTA described herein to a subject, may farther comprise administering to the subject an anti-PD1 antibody (e.g., pembrolizumab, cemiplimab, pidilizumab, or nivolumab), or an anti-PD-L1 antibody (e.g., atezolizumab, avelumab, durvaniab, BMS-936552, or CK-301), or an anti-CTLA-4 antibody (e.g. ipilimumab).

In specific embodiments, an antibody or an antigen-binding fragment thereof that specifically binds to VISTA, or an antibody-drug conjugate described herein, or cell expressing a CAR described herein is administered to a subject in combination with anti-PD-1 antibody (e.g., pembrolizumab). In a specific embodiment, both the therapies are administered concurrently, e.g., on the same day, optionally once every 3 weeks. In a specific embodiment, both the therapies are administered on the same day, e.g., once every 3 weeks. In a specific embodiment, the anti-PD-1 antibody is administered to a human subject at a dose of 200 mg. In specific embodiments, an immunoglobulin antibody (or antigen-binding fragment or conjugate thereof) that specifically binds to VISTA described herein is administered to a human subject at a dose of 30 mg, 100 mg, 300 mg, 1 g, or 3 g, or in the range of 100 to 300 mg, 200 mg to 1 g, 300 mg to 1 g, or 1 g to 3 g, administered weekly, every other week, or every three weeks concurrently with anti-PD-1 antibody (e.g., pembrolizumab) at a dose and dose interval as printed on its prescribing information. In a specific embodiment, an immunoglobulin antibody (or antigen-binding fragment or conjugate thereof) that specifically binds to VISTA described herein is administered to an adult human subject at a dose in the range of 0.2 to 3 g, given twice weekly to once every 3 weeks, optionally once weekly, every 2 or 3 weeks, more optionally once every 3 weeks, and optionally wherein the subject is given at least 5 doses. In a specific embodiment, an above-described regimen is used to treat a patient with advanced solid tumor. In specific embodiments, an above-described regimen is used to treat a patient with metastatic or recurrent non-small cell lung cancer (NSCLC). In specific embodiments, an above-described regimen is used to treat a patient with metastatic or recurrent head and neck squamous cell carcinoma (HNSCC). In specific embodiments, an above-described regimen is used to treat a patient with recurrent or progressive hepatocellular carcinoma (HCC), CRC, or colon cancer, optionally who has failed sorafenib alone or in combination with an inhibitor of PD-1 or PDL1, e.g., the cancer is resistant to sorafenib alone or in combination with an inhibitor of PD-1 or PDL1. In specific embodiments, an above-described regimen is used to treat a patient with metastatic or recurrent ovarian cancer, optionally who has failed at least two prior therapies, e.g., the cancer is resistant to at least two prior therapies. In specific embodiments, an above-described regimen is used to treat a patient with metastatic or recurrent cervical cancer, optionally who has failed at least two prior therapies, e.g., the cancer is resistant to at least two prior therapies. In specific embodiments, an above-described regimen is used to treat a patient who has failed prior chemotherapy (e.g. carboplatin and paclitaxel), e.g., the cancer is resistant to chemotherapy (e.g., carboplatin and paclitaxel). In specific embodiments, an above-described regimen is used to treat a patient who has failed radiation therapy in combination with therapy with an inhibitor of PD-1 or PDL1, e.g., the cancer is resistant to radiation therapy in combination with therapy with an inhibitor of PD-1 or PDL1. In specific embodiments, an above-described regimen is used to treat a patient who has failed chemotherapy in combination with radiation therapy and therapy with an inhibitor of PD-1 or PDL1, e.g., the cancer is resistant to chemotherapy in combination with radiation therapy and therapy with an inhibitor of PD-1 or PDL1.

In specific embodiments, an above-described regimen is used to treat a NSCLC a patient with non-squamous histology and with progressive/recurrent disease who has failed prior chemotherapy (e.g., carboplatin/paclitaxel or carboplatin/premetrexed) and/or PD-(L)-1 inhibitor therapy, e.g., the cancer is resistant to prior chemotherapy (e.g., carboplatin/paclitaxel or carboplatin/premetrexed) and/or PD-(L)-1 inhibitor therapy. In a specific embodiment, a patient is treated who has a cancer with an EGFR mutation, who has failed prior EGFR tyrosine kinase inhibitor therapy, e.g., the cancer is resistant to EGFR tyrosine kinase inhibitor therapy. In a specific embodiment, a patient is treated who has a cancer with an ALK translocation who has failed prior ALK inhibitor therapy, e.g., the cancer is resistant to ALK inhibitor therapy.

In specific embodiments, an above-described regimen is used to treat HNSCC that is histologically confirmed, incurable, locally advanced, recurrent and/or metastatic. A patient may have failed a prior platinum-containing regimen (e.g., the cancer is resistant to a platinum-containing regimen) and/or not be a candidate for further radiation or surgical therapy with a curative intent.

In specific embodiments, an above-described regimen is used to treat hepatocellular carcinoma that is progressive and that has failed prior sorafenib therapy, e.g., the cancer is resistant to sorafenib. In specific embodiments, an above-described regimen is used to treat a patient with recurrent or metastatic cervical cancer who has failed prior platinum-based therapy, e.g., the cancer is resistant to platinum-based therapy. In specific embodiments, an above-described regimen is used to treat ovarian cancer that has progressed following platinum-containing systemic therapy.

In specific embodiments a method of treatment provided herein further comprises treating the subject with a chemotherapeutic agent and an immune checkpoint inhibitor. In specific embodiments, the immune checkpoint inhibitor is an inhibitor of PD-1, PDL1, or cytotoxic T-lymphocyte-associated protein 4 (CTLA-4).

An antibody or an antigen-binding fragment thereof that specifically binds to VISTA, or antibody-drug conjugate, or cell expressing a CAR, as described herein, can be administered with an additional therapy concurrently and/or sequentially (before and/or after). The antibody or antigen binding fragment thereof, or antibody-drug conjugate, or cell, and the additional therapy can be administered in the same or different compositions, and by the same or different routes of administration. A first therapy (e.g., an antibody or an antigen-binding fragment thereof that specifically binds to VISTA, or the additional therapy) can be administered prior to, concomitantly with, or subsequent to the administration of the second therapy (e.g., antibody or an antigen-binding fragment thereof that specifically binds to VISTA described herein, or the additional therapy) to a subject with cancer.

In specific embodiments, a first therapy (e.g., an antibody or an antigen-binding fragment thereof that specifically binds to VISTA, or the additional therapy) is administered to a subject with cancer on the same day, in the same week, or in the same month as a second therapy (e.g., antibody or an antigen-binding fragment thereof that specifically binds to VISTA described herein, or the additional therapy). In specific embodiments, a first therapy (e.g., an antibody or an antigen-binding fragment thereof that specifically binds to VISTA, or the additional therapy) is administered to a subject with cancer within 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks of the administration of a second therapy (e.g., antibody or an antigen-binding fragment thereof that specifically binds to VISTA described herein, or the additional therapy).

In certain embodiments, an additional therapy administered to a subject in combination with an antibody or an antigen-binding fragment thereof that specifically binds to VISTA described herein is administered in the same composition (pharmaceutical composition). In specific embodiments, an additional therapy administered in combination with an antibody or an antigen-binding fragment thereof that specifically binds to VISTA described herein is administered to a subject in a different composition than the antibody or an antigen-binding fragment thereof that specifically binds to VISTA (e.g., two or more pharmaceutical compositions are used).

1.7 Kits

Also provided herein are kits comprising an antibody or an antigen-binding fragment thereof that specifically binds to VISTA described herein, an antibody-drug conjugate described herein (e.g., comprising an antibody or an antigen-binding fragment thereof that specifically binds to VISTA described herein bound to a therapeutic agent), or a cell expressing a CAR comprising an scFv described herein. In a specific embodiment, provided herein is a pharmaceutical pack or kit comprising one or more containers filled with one or more of the ingredients of the pharmaceutical compositions described herein, such as, for example, one or more antibodies or antigen-binding fragments thereof that specifically binds to VISTA described herein. In specific embodiments, the kits contain a pharmaceutical composition described herein and a prophylactic or therapeutic agent.

Optionally associated with such container(s) can be a notice in the form prescribed by a governmental agency regulating the manufacture, use or sale of pharmaceuticals or biological products, a dosage form, and/or instructions for use thereof. In certain embodiments, the instructions included with the kit provide guidance with respect to the dosage amounts and/or dosing regimens for administration of the pharmaceutical composition(s).

Examples of pharmaceutical packaging materials include, but are not limited to, blister packs, bottles, packets, sachets, tubes, inhalers, pumps, bags, vials, containers, syringes and any packaging material suitable for a selected pharmaceutical composition and intended mode of administration and treatment.

Kits provided herein can further include devices that are used to administer the active ingredients. Examples of such devices include, but are not limited to, syringes, needle-less injectors, drip bags, patches and inhalers.

Kits provided herein can further include pharmaceutically acceptable vehicles that can be used to administer the ingredients. For example, if an ingredient is provided in a solid form that must be reconstituted for parenteral administration, the kit can comprise a sealed container of a suitable vehicle in which the ingredient can be dissolved to form a particulate-free sterile solution that is suitable for parenteral administration or can be reconstituted as a suspension for oral administration. Examples of pharmaceutically acceptable vehicles include, but are not limited to: aqueous vehicles including, but not limited to, Water for Injection USP, Sodium Chloride Injection, Ringer's Injection, Dextrose Injection, Dextrose and Sodium Chloride Injection, and Lactated Ringer's Injection; water-miscible vehicles including, but not limited to, ethyl alcohol, polyethylene glycol, and polypropylene glycol; and non-aqueous vehicles including, but not limited to, corn oil, cottonseed oil, peanut oil, sesame oil, ethyl oleate, isopropyl myristate, and benzyl benzoate.

EXAMPLES

The examples described in this section are provided for illustration.

Example 1: Antibodies Generated Against VISTA Protein

Immunizations: Five transgenic mice carrying inserted human immunoglobulin genes (Trianni® mice; see WO 2012/018610 A2) were immunized with soluble extracellular domain (ECD) of human VISTA (SEQ ID NO: 378) (except with a His tag on the VISTA-ECD protein (R&D Systems)) using ALD/MDP (alhydrogel/muramyl dipeptide) as an adjuvant. Ten μg of immunogen was injected into the footpad of each mouse twice per week for four weeks. Antibody titer was assessed by enzyme-linked immunosorbent assay (ELISA) using a 1:3 dilution series of each animal's serum, starting at 1000 ng/mL. Two final footpad boosts of 10 μg soluble VISTA-ECD without adjuvant were given to each animal before harvest. Lymph nodes (popliteal, inguinal, axillary, and mesenteric), spleen, and bone marrow were collected after sacrifice. Single cell suspensions for each animal tissue were made by manual disruption followed by passage through a 70 μm mesh filter. The EasySep™ Mouse Pan-B Cell Isolation Kit (Stemcell Technologies) negative selection kit was used to isolate B cells from lymph nodes and spleen, while the Mouse CD138+ (Miltenyi Biotec) positive selection kit was used to isolate B cells from bone marrow. The B cell populations were quantified by counting on a C-Chip hemocytometer (Incyto) and assessed for viability using Trypan blue. The cells were then diluted to 5,000-6,000 cells/mL in phosphate-buffered saline (PBS) with 12% OptiPrep™ Density Gradient Medium (Sigma). This cell mixture was used for microfluidic encapsulation. Approximately one million B cells were run from each immunized animal through the emulsion droplet microfluidics platform.

Preparation of paired heavy and light chain libraries: A DNA library encoding scFvs with native heavy-light Ig pairing intact was generated from RNA of single cells using the emulsion droplet microfluidics platform or vortex emulsions. The method for generating the DNA library was divided into 1) poly(A)+mRNA capture, 2) multiplexed overlap extension reverse transcriptase polymerase chain reaction (OE-RT-PCR), and 3) nested PCR to remove artifacts and add adapters for deep sequencing or yeast display libraries. The scFv libraries were generated from approximately 400,000 B cells (lymph nodes and spleen) or 30,000 B cells (bone marrow) from each of the five animals that achieved a positive ELISA titer.

For poly(A)+mRNA capture, a custom designed co-flow emulsion droplet microfluidic chip was used as previously described (see Asensio M A, et al., Antibody repertoire analysis of mouse immunization protocols using microfluidics and molecular genomics. Mabs. 2019 11(5):870-883). The microfluidic chip has two input channels for oil, one input channel for the cell suspension mix described above, and one input channel for oligo-dT beads (NEB) at 1.25 mg/ml in cell lysis buffer (20 mM Tris pH 7.5, 0.5 M NaCl, 1 mM ethylenediaminetetraacetic acid (EDTA), 0.5% Tween-20, and 20 mM dithiothreitol). The beads were extracted from the droplets using Pico-Break (Dolomite).

For multiplex overlap extension real time polymerase chain reaction (OE-RT-PCR), glass Telos droplet emulsion microfluidic chips (Dolomite) were used. mRNA-bound beads were resuspended in OE-RT-PCR mix with a mineral oil-based surfactant mix (GigaGen). The OE-RT-PCR mix contains 2× one-step RT-PCR buffer, 2.0 mM $MgSO_4$, Superscript III reverse transcriptase, and Platinum Taq (Thermo Fisher Scientific), plus a mixture of primers directed against the IgK C region, the IgG C region, and all V regions. The overlap region was a DNA sequence that encodes a Gly-Ser rich scFv linker sequence. PCR methods and primers are as previously described (see Adler A S et al., Rare, high-affinity anti-pathogen antibodies from human repertoires, discovered using microfluidics and molecular genomics. Mabs. 2017 9(8):1282-1296). The DNA fragments were recovered from the droplets using a droplet breaking solution (GigaGen) and then purified using QIAquick PCR Purification Kit (Qiagen).

For nested PCR, the purified OE-RT-PCR product was first run on a 1.7% agarose gel for 80 minutes at 150 V. A band at 1200-1500 base pair (bp) corresponding to the linked product was excised and purified using NucleoSpin Gel and PCR Clean-up Kit (Macherey Nagel). PCR was then performed to add adapters for Illumina sequencing or yeast display; for sequencing, a randomer of seven nucleotides was added to increase base calling accuracy in subsequent next generation sequencing steps. Nested PCR was performed with 2×NEBNext High-Fidelity amplification mix (NEB) with either Illumina adapter containing primers or primers for cloning into the yeast expression vector. The nested PCR product was run on a 1.2% agarose gel for 50 minutes at 150 V. A band at 800-1100 bp was excised and purified using NucleoSpin Gel and PCR Clean-up Kit (Macherey Nagel).

Antigen preparation for FACS analysis: Human IgG1-Fc (Thermo Fisher Scientific) and VISTA-ECD-His (R&D Systems) proteins were biotinylated using the EZ-Link Micro Sulfo-NHS-LC-Biotinylation kit (Thermo Fisher Scientific). The biotinylation reagent was resuspended to 9 mM and added to the protein at a 50-fold molar excess. The reaction was incubated on ice for 2 hours and then the biotinylation reagent was removed using Zeba desalting columns (Thermo Fisher Scientific). The final protein concentration was calculated with a Bradford assay.

Yeast library screening: Yeast display DNA screening libraries were prepared as previously described (see Adler A S et al. Rare, high-affinity anti-pathogen antibodies from human repertoires, discovered using microfluidics and molecular genomics. Mabs. 2017 9(8):1282-1296.). A yeast surface display vector (pYD) that contains a GAL1/10 promoter, an Aga2 cell wall tether, and a C-terminal c-Myc tag was built. The GAL1/10 promoter induces expression of the scFv protein in medium that contains galactose. The Aga2 cell wall tether was required to shuttle the scFv to the yeast cell surface and tether the scFv to the extracellular space. The c-Myc tag was used during the flow sort to stain for yeast cells that express in-frame scFv protein. *Saccharomyces cerevisiae* cells (ATCC) were electroporated (Bio-Rad Gene Pulser II; 0.54 kV, 25 uF, resistance set to infinity) with gel-purified nested PCR product and linearized pYD vector for homologous recombination in vivo. Transformed cells were expanded and induced with galactose to generate yeast scFv display libraries.

Two million yeast cells from the expanded scFv libraries were stained with anti-c-Myc (Thermo Fisher Scientific A21281) and an AF488-conjugated secondary antibody (Thermo Fisher Scientific A11039). To select scFv-expressing cells that bind to VISTA-ECD, biotinylated VISTA-ECD antigen was added to the yeast culture (250 nM final) during primary antibody incubation and then stained with PE-streptavidin (Thermo Fisher Scientific). Yeast cells were flow sorted on a BD Influx (Stanford Shared FACS Facility) for double-positive cells (AF488+/PE+), and recovered clones were then plated on SD-CAA plates with kanamycin, streptomycin, and penicillin (Teknova) for expansion. The expanded first round FACS clones were then subjected to a second round of FACS with the same antigen at the same molarity (250 nM final). Plasmid minipreps (Zymo Research) were prepared from yeast recovered from the final FACS sort. Tailed-end PCR was used to add Illumina adapters to the plasmid libraries for deep sequencing.

Deep repertoire sequencing: Deep antibody sequencing libraries were quantified using a quantitative PCR Illumina Library Quantification Kit (KAPA) and diluted to 17.5 pM. Libraries were sequenced on a MiSeq (Illumina) using a 500 cycle MiSeq Reagent Kit v2, according to the manufacturer's instructions. To obtain high quality sequence reads with maintained heavy and light chain linkage, sequencing was performed in two separate runs. In the first run ("linked run"), the scFv libraries were directly sequenced to obtain forward read of 340 cycles for the light chain V-gene and CDR3, and reverse read of 162 cycles that cover the heavy chain CDR3 and part of the heavy chain V-gene. In the second run ("unlinked run"), the scFv library was first used as a template for PCR to separately amplify heavy and light chain V-genes. Then, overlapping forward and reverse reads of 251 cycles for the heavy and light chain Ig were obtained separately.

To remove base call errors, the expected number of errors (E) for a read were calculated from its Phred scores. By default, reads with E>1 were discarded, leaving reads for which the most probable number of base call errors is zero. As an additional quality filter, singleton nucleotide reads were discarded, because sequences found two or more times have a high probability of being correct. Finally, high-quality, linked antibody sequences were generated by merging filtered sequences from the linked and unlinked runs.

To identify reading frame and FR/CDR junctions, a database of well-curated immunoglobulin sequences (Le Franc M P, et al. IMGT, the international ImMunoGeneTics information system. Nucl. Acids Res. 2019 37:D1006-10012) was first processed to generate position-specific sequence matrices (PSSMs) for each FR/CDR junction. These PSSMs were used to identify FR/CDR junctions for each of the merged nucleotide sequences generated using the processes described above. This identified the protein reading frame for each of the nucleotide sequences. Reads were required to have a valid predicted CDR3 sequence, so, for example, reads with a frame-shift between the V and J segments were discarded. Next, UBLAST was run using the scFv nucleotide sequences as queries and V and J gene sequences from the IMGT database as the reference sequences. The UBLAST alignment with the lowest E-value was used to assign V and J gene families and compute % ID to germline.

FACS enrichment of the yeast library and subsequent sequence data analysis identified 107 unique scFv sequences. Pairwise alignment was used to cluster the scFv sequences into clades based upon similarity in the CDR3 sequences. Full-length human IgG1 monoclonal antibodies were reformatted from the identified scFv sequences.

Example 2: Production and Characterization of Monoclonal Antibodies in HEK293 Cells Monoclonal anti-VISTA antibodies were produced in HEK293 cells. Sequences for each antibody were codon optimized and cloned into the Eco RI and Hind III sites of pcDNA3.4. Each heavy and light chain sequence was cloned separately. Transfection-grade plasmid DNA was prepared according to standard methods. Expi293F (Thermo Fisher Scientific) cells were grown in serum-free Expi293 expression media (Thermo Fisher Scientific) in Erlenmeyer Flasks (Corning Inc) at 37° C. in 8% $CO_2$ on an orbital shaker. One day before transfection, the cells were seeded at an optimal density ($3\times10^6$ cells/mL) and transfected the following day with antibody DNA using commercial transfection reagent (Expifectamine) according to the manufacturers recommended conditions. Approximately 16-18 hours post-transfection, ExpiFectamine 293 Transfection Enhancer 1 and ExpiFectamine 293 Transfection Enhancer 2 were added to each flask, and the transfected cultures were incubated for 6 days prior to harvest. Cell culture broth was collected by centrifugation of the cell pellet followed by filtration of the media. For small scale production, antibodies were purified from culture supernatants on one of four columns: RoboColumn Eshmuno A (EMD Millipore), PreDictor RoboColumn MabSelect Sure (Cytiva/GE), HiTrap MabSelect SuRe (Cytiva/GE) or HiTrap MabSelect SuRe LX (Cytiva/GE). The columns were used for antibody purification according to the manufacturer's recommendation, and the resulting eluate was buffer exchanged into phosphate buffered saline, pH 7.4. Samples were analyzed for protein concentration by absorbance at 280 nm and for purity by SDS-PAGE. Endotoxin levels were evaluated using LAL Endotoxin Assay Kit (Bioendo).

Larger bench-scale productions (up to 500 mL of media) were purified using MabSelect SuRe LX and HiLoad 16/600 Superdex200pg columns and evaluated for purity and protein concentration as above. In addition, sample purity was measured by Western blot using goat anti-human IgG-HRP (Genescript) or goat anti-human kappa-HRP (SouthernBiotech) and by SEC-HPLC on a Tosoh TSKgel G3000SWxl 7.8×300 mm column resolved in 0.1 mol/L $Na_2SO_4$ in 0.1 mol/L phosphate buffer pH 6.7.

Example 3: Production and Characterization of Monoclonal Antibodies in CHO Cells DNA plasmids for production of antibodies in CHO cells were prepared from overnight cultures of *E coli* DH5.alpha using the Qiagen Endofree Maxi kit (Cat No. 12362), the Sigma Aldrich GenElute High (HP) Endotoxin Free Maxi Plasmid Purification Kit (Cat No NA0410) or the Invitrogen PureLink Expi Endotoxin-Free Maxi Plasmid Purification Kit (Cat No A31217). Plasmid DNA was prepared according to the manufacturer's recommendations for each kit. Plasmid DNA was sterile filtered using 13 mm×0.22 μm filters (Foxx Life Sciences Cat No 371-2115). DNA concentrations were determined using the NanoDrop instrument (Thermo Fisher Scientific). The Expi-CHO expression cell line was purchased from Thermo Fisher Scientific (Cat No A29133). Expi-CHO cells were propagated in Erlenmeyer shake flasks in ExpiCho Expression Medium (Thermo) at 37° C. and 8%

$CO_2$, shaking at 125 RPM to a maximum cell density of 4-6×$10^6$ cells/mL. For routine expansion of cell populations, cell cultures were diluted to 0.1-0.5×$10^6$ cells/mL. Cells were transfected at a density of 6×$10^6$ cells/mL with 0.5 μg/mL plasmid DNA from each of the heavy and light antibody chains. One day after transfection, ExpiCHO Enhancer was added to the culture, and the cells were shifted to 32° C. and 5% $CO_2$ for subsequent growth. ExpiCHO enhancer was added again 5 days after transfection, and cells were grown under the same conditions until viability was 575%, at which time the culture was harvested.

CHO cells were removed by centrifugation, and the culture supernatant was filtered through a 0.2 μm filter. Monoclonal antibodies were purified from culture media by GE AKTA FPLC using PROchievA Recombinant Protein A Resin (J. T. Baker, Cat No JT7899). The protein A column was equilibrated with 20 mM $NaPO_4$ monobasic pH 7.4 (EMD Cat No SX-0710-3). Cell culture supernatant was applied to the column, the protein A resin was washed with 20 mM $NaPO_4$ monobasic pH 7.4, and bound antibody was eluted with 0.10 M citric acid pH 3.0 (EMD, Cat No 1.00242.0500). Antibody elution fractions were collected and neutralized with one-fifth volume of 1M Tris HCl pH 9.0 (JT Baker, Cat No. 4103-01). Fractions containing purified antibody were buffer exchanged with either Amicon Ultra-15 centrifugal filter units (Cat No UFC905024) or by dialysis against PBS pH 7.4.

Purified antibody was evaluated by SDS-PAGE under reducing and non-reducing conditions on precast 1 mm 4-12% Bis-Tris Gels (Thermo Fisher Scientific) electrophoresed in MES running buffer (Thermo Fisher Scientific). Gels were stained with Coomassie blue and imaged. Purified antibodies were also evaluated by SEC-HPLC at 220 nm on a Tosoh TSKgel G3000SWXL column using 0.2 M sodium phosphate pH 6.7 as the mobile phase. Endotoxin contamination was measured using the Charles River Endosafe PTS100.

Example 4: Antibody Affinity Determination Using Octet

Octet scouting: Antibody affinities were measured using biolayer interferometry (BLI) on the Octet Red 96 (ForteBio) system. Anti-human IgG Fc Capture (AHC) dip and read sensors (ForteBio) were used to capture each anti-VISTA antibody formatted as either an IgG1 or IgG4 and diluted to 20 μg/mL in PBS pH 7.4. AHC sensors were dipped into antibody solution for 180 s to capture each IgG on the sensor. An initial baseline was established by soaking each sensor in PBS pH 7.4 for an additional 120 s. Initial affinity screening was performed with His-tagged recombinant VISTA-ECD (Met 1 to Ala 194) expressed in HEK 293 cells (Sino Biological) and diluted to 50 nM-300 nM in PBS pH 7.4. Human, cynomolgus monkey, and mouse VISTA-ECD were evaluated. Studies were performed by association with VISTA-ECD for 240 s and dissociation in PBS pH 7.4 for 360 s. Data analysis was performed using Octet Data Analysis software version 9.0.0.14. In general, baseline alignment without subtraction was used for raw data processing. A Savitzky-Golay digital filter was used to remove high-frequency noise, and processed data were globally fit to a 1:1 binding model. Where binding was present, the affinity constant ($K_D$) was calculated for each antibody-antigen pair.

In some cases, avidity rather than affinity was measured by capturing VISTA-ECD on an Anti-Penta-His (HIS1K, ForteBio) sensor and measuring the binding kinetics of the anti-VISTA antibody to immobilized VISTA-ECD.

Representative data are shown for each antibody in FIGS. 1A-1N, 2A-2G and 3A-3G and Table 14 and Table 15. Data from multiple independent experiments is represented as separate rows in each table. Each antibody potently bound with low nM affinity to both human and cynomolgus monkey VISTA-ECD. None of the antibodies demonstrated measurable binding to mouse VISTA-ECD, and $K_D$ values for mouse were not calculated. As expected for divalent antibodies, avidity was greater than affinity when the Octet format was reversed.

TABLE 14

Octet binding affinity data for anti-VISTA monoclonal antibodies to human VISTA-ECD

| Sensor Type | Sample ID | Loading Sample ID | Conc. (nM) | Response | KD (M) | KD Error | Kon (1/Ms) | kon Error | Kdis (1/s) |
|---|---|---|---|---|---|---|---|---|---|
| AHC | hu.VISTA | 269.1 | 50 | 0.2985 | 2.86 × $10^{-9}$ | 3.11 × $10^{-11}$ | 1.34 × $10^{5}$ | 6.87 × $10^{2}$ | 3.82 × $10^{-4}$ |
| AHC | hu.VISTA | 269.1 | 50 | 0.2853 | 1.45 × $10^{-9}$ | 1.43 × $10^{-11}$ | 2.56 × $10^{5}$ | 8.65 × $10^{2}$ | 3.72 × $10^{-4}$ |
| AHC | hu.VISTA | 269.1 | 50 | 0.2697 | 1.49 × $10^{-9}$ | 1.59 × $10^{-11}$ | 2.38 × $10^{5}$ | 8.54 × $10^{2}$ | 3.54 × $10^{-4}$ |
| AHC | hu.VISTA | 269.1 | 50 | 0.2982 | 1.61 × $10^{-9}$ | 1.60 × $10^{-11}$ | 2.42 × $10^{5}$ | 8.73 × $10^{2}$ | 3.89 × $10^{-4}$ |
| HIS1K | 269.1 | hu.VISTA | 133.3 | 0.3738 | <1 × $10^{-12}$ | 2.08 × $10^{-11}$ | 4.15 × $10^{5}$ | 5.02 × $10^{3}$ | <1 × $10^{-7}$ |
| AHC | hu.VISTA | 321.1 | 50 | 0.2414 | 2.44 × $10^{-9}$ | 3.76 × $10^{-11}$ | 9.57 × $10^{4}$ | 5.86 × $10^{2}$ | 2.33 × $10^{-4}$ |
| AHC | hu.VISTA | 321.1 | 50 | 0.2719 | 1.0 × $10^{-9}$ | 1.79 × $10^{-11}$ | 1.80 × $10^{5}$ | 6.67 × $10^{2}$ | 1.83 × $10^{-4}$ |
| AHC | hu.VISTA | 321.1 | 50 | 0.3044 | 1.13 × $10^{-9}$ | 2.72 × $10^{-11}$ | 1.65 × $10^{5}$ | 8.91 × $10^{2}$ | 1.86 × $10^{-4}$ |
| AHC | hu.VISTA | 321.1 | 50 | 0.3048 | 1.28 × $10^{-9}$ | 1.62 × $10^{-11}$ | 1.82 × $10^{5}$ | 6.03 × $10^{2}$ | 2.34 × $10^{-4}$ |
| AHC | hu.VISTA | 245.1 | 50 | 0.2681 | 1.88 × $10^{-9}$ | 3.28 × $10^{-11}$ | 1.68 × $10^{5}$ | 1.04 × $10^{3}$ | 3.15 × $10^{-4}$ |
| AHC | hu.VISTA | 245.1 | 50 | 0.2759 | 8.55 × $10^{-10}$ | 1.10 × $10^{-11}$ | 2.44 × $10^{5}$ | 6.51 × $10^{2}$ | 2.09 × $10^{-4}$ |
| AHC | hu.VISTA | 245.1 | 50 | 0.3204 | 1.14 × $10^{-9}$ | 1.17 × $10^{-11}$ | 2.41 × $10^{5}$ | 6.59 × $10^{2}$ | 2.75 × $10^{-4}$ |
| AHC | hu.VISTA | 245.1 | 50 | 0.31 | 9.09 × $10^{-10}$ | 1.30 × $10^{-11}$ | 2.55 × $10^{5}$ | 8.22 × $10^{2}$ | 2.32 × $10^{-4}$ |

TABLE 14-continued

Octet binding affinity data for anti-VISTA monoclonal antibodies to human VISTA-ECD

| | | | | | | | | | |
|---|---|---|---|---|---|---|---|---|---|
| AHC | hu.VISTA | 245.4 | 50 | 0.1889 | $2.63 \times 10^{-9}$ | $3.50 \times 10^{-11}$ | $1.59 \times 10^{5}$ | $9.71 \times 10^{2}$ | $4.17 \times 10^{-4}$ |
| AHC | hu.VISTA | 465.1 | 50 | 0.2527 | $2.83 \times 10^{-9}$ | $4.92 \times 10^{-11}$ | $1.01 \times 10^{5}$ | $7.94 \times 10^{2}$ | $2.87 \times 10^{-4}$ |
| AHC | hu.VISTA | 465.1 | 50 | 0.27 | $1.48 \times 10^{-9}$ | $1.29 \times 10^{-11}$ | $2.09 \times 10^{5}$ | $5.74 \times 10^{2}$ | $3.09 \times 10^{-4}$ |
| AHC | hu.VISTA | 465.1 | 50 | 0.3063 | $1.95 \times 10^{-9}$ | $1.44 \times 10^{-11}$ | $1.97 \times 10^{5}$ | $5.63 \times 10^{2}$ | $3.82 \times 10^{-4}$ |
| AHC | hu.VISTA | 465.1 | 50 | 0.29 | $1.66 \times 10^{-9}$ | $1.43 \times 10^{-11}$ | $2.20 \times 10^{5}$ | $6.72 \times 10^{2}$ | $3.66 \times 10^{-4}$ |
| AHC | hu.VISTA | 465.4 | 50 | 0.1847 | $3.21 \times 10^{-9}$ | $4.53 \times 10^{-11}$ | $1.13 \times 10^{5}$ | $7.99 \times 10^{2}$ | $3.62 \times 10^{-4}$ |
| AHC | hu.VISTA | 457.1 | 50 | 0.2755 | $1.46 \times 10^{-9}$ | $2.65 \times 10^{-11}$ | $1.45 \times 10^{5}$ | $7.17 \times 10^{2}$ | $2.11 \times 10^{-4}$ |
| AHC | hu.VISTA | 457.1 | 50 | 0.2951 | $7.48 \times 10^{-10}$ | $1.10 \times 10^{-11}$ | $2.68 \times 10^{5}$ | $7.62 \times 10^{2}$ | $2.00 \times 10^{-4}$ |
| AHC | hu.VISTA | 457.1 | 50 | 0.352 | $9.80 \times 10^{-10}$ | $1.08 \times 10^{-11}$ | $2.33 \times 10^{5}$ | $5.90 \times 10^{2}$ | $2.29 \times 10^{-4}$ |
| AHC | hu.VISTA | 457.1 | 50 | 0.3446 | $8.73 \times 10^{-10}$ | $1.34 \times 10^{-11}$ | $2.78 \times 10^{5}$ | $9.80 \times 10^{2}$ | $2.43 \times 10^{-4}$ |
| AHC | hu.VISTA | 173.1 | 50 | 0.3276 | $1.89 \times 10^{-9}$ | $1.50 \times 10^{-11}$ | $1.40 \times 10^{5}$ | $3.81 \times 10^{2}$ | $2.65 \times 10^{-4}$ |
| AHC | hu.VISTA | 173.1 | 50 | 0.2918 | $1.29 \times 10^{-9}$ | $2.16 \times 10^{-11}$ | $1.70 \times 10^{5}$ | $7.35 \times 10^{2}$ | $2.20 \times 10^{-4}$ |
| AHC | hu.VISTA | 173.4 | 50 | 0.2491 | $1.52 \times 10^{-9}$ | $1.67 \times 10^{-11}$ | $1.74 \times 10^{5}$ | $5.73 \times 10^{2}$ | $2.64 \times 10^{-4}$ |
| AHC | hu.VISTA | 833.1 | 50 | 0.3343 | $2.13 \times 10^{-9}$ | $1.51 \times 10^{-11}$ | $2.29 \times 10^{5}$ | $7.19 \times 10^{2}$ | $4.86 \times 10^{-4}$ |
| AHC | hu.VISTA | 474.1 | 50 | | $4.65 \times 10^{-10}$ | | $5.34 \times 10^{5}$ | | $2.48 \times 10^{-4}$ |
| AHC | hu.VISTA | 150.1 | 50 | | $8.03 \times 10^{-10}$ | | $2.81 \times 10^{5}$ | | $2.26 \times 10^{-4}$ |

| | Sensor Type | kdis Error | RMax | RMax Error | Kobs (1/s) | Req | Req/ Rmax(%) | Full X ^ 2 | Full R ^ 2 |
|---|---|---|---|---|---|---|---|---|---|
| | AHC | $3.66 \times 10^{-6}$ | 0.3902 | 0.0011 | $7.06 \times 10^{-3}$ | 0.3691 | 94.6 | 0.0034 | 0.9989 |
| | AHC | $3.44 \times 10^{-6}$ | 0.3044 | 0.0004 | $1.32 \times 10^{-2}$ | 0.2958 | 97.2 | 0.0028 | 0.9985 |
| | AHC | $3.55 \times 10^{-6}$ | 0.2907 | 0.0004 | $1.22 \times 10^{-2}$ | 0.2822 | 97.1 | 0.0027 | 0.9985 |
| | AHC | $3.61 \times 10^{-6}$ | 0.3259 | 0.0005 | $1.25 \times 10^{-2}$ | 0.3158 | 96.9 | 0.0034 | 0.9984 |
| | HIS1K | | 0.363 | 0.0006 | $5.53 \times 10^{-2}$ | 0.363 | 100 | 0.0448 | 0.957 |
| | AHC | $3.30 \times 10^{-6}$ | 0.3726 | 0.0015 | $5.02 \times 10^{-3}$ | 0.3552 | 95.4 | 0.0019 | 0.9992 |
| | AHC | $3.15 \times 10^{-6}$ | 0.3119 | 0.0005 | $9.19 \times 10^{-3}$ | 0.3057 | 98 | 0.0022 | 0.999 |
| | AHC | $4.36 \times 10^{-6}$ | 0.3676 | 0.001 | $8.42 \times 10^{-3}$ | 0.3595 | 97.8 | 0.0054 | 0.9983 |
| | AHC | $2.85 \times 10^{-6}$ | 0.351 | 0.0005 | $9.34 \times 10^{-3}$ | 0.3423 | 97.5 | 0.0022 | 0.9992 |
| | AHC | $5.14 \times 10^{-6}$ | 0.3132 | 0.0009 | $8.70 \times 10^{-3}$ | 0.3018 | 96.4 | 0.0053 | 0.9975 |
| | AHC | $2.63 \times 10^{-6}$ | 0.2938 | 0.0003 | $1.24 \times 10^{-2}$ | 0.2889 | 98.3 | 0.0016 | 0.9992 |
| | AHC | $2.70 \times 10^{-6}$ | 0.3447 | 0.0004 | $1.23 \times 10^{-2}$ | 0.337 | 97.8 | 0.0023 | 0.9992 |
| | AHC | $3.23 \times 10^{-6}$ | 0.3292 | 0.0004 | $1.30 \times 10^{-2}$ | 0.3233 | 98.2 | 0.0031 | 0.9987 |
| | AHC | $4.93 \times 10^{-6}$ | 0.2297 | 0.0007 | $8.35 \times 10^{-3}$ | 0.2182 | 95 | 0.0023 | 0.9978 |
| | AHC | $4.45 \times 10^{-6}$ | 0.3817 | 0.0019 | $5.35 \times 10^{-3}$ | 0.3612 | 94.6 | 0.0037 | 0.9985 |
| | AHC | $2.56 \times 10^{-6}$ | 0.3011 | 0.0004 | $1.07 \times 10^{-2}$ | 0.2925 | 97.1 | 0.0014 | 0.9993 |
| | AHC | $2.60 \times 10^{-6}$ | 0.3509 | 0.0004 | $1.02 \times 10^{-2}$ | 0.3377 | 96.3 | 0.0018 | 0.9993 |
| | AHC | $2.93 \times 10^{-6}$ | 0.3206 | 0.0004 | $1.14 \times 10^{-2}$ | 0.3102 | 96.8 | 0.0021 | 0.9991 |
| | AHC | $4.43 \times 10^{-6}$ | 0.2634 | 0.0011 | $6.02 \times 10^{-3}$ | 0.2476 | 94 | 0.0019 | 0.9985 |
| | AHC | $3.68 \times 10^{-6}$ | 0.3457 | 0.0009 | $7.44 \times 10^{-3}$ | 0.336 | 97.2 | 0.0031 | 0.9988 |
| | AHC | $2.89 \times 10^{-6}$ | 0.309 | 0.0003 | $1.36 \times 10^{-2}$ | 0.3044 | 98.5 | 0.0023 | 0.999 |

TABLE 14-continued

Octet binding affinity data for anti-VISTA monoclonal antibodies to human VISTA-ECD

| | | | | | | | | |
|---|---|---|---|---|---|---|---|---|
| AHC | 2.46 × $10^{-6}$ | 0.3849 | 0.0004 | 1.19 × $10^{-2}$ | 0.3775 | 98.1 | 0.0023 | 0.9993 |
| AHC | 3.62 × $10^{-6}$ | 0.3586 | 0.0004 | 1.42 × $10^{-2}$ | 0.3525 | 98.3 | 0.0048 | 0.9983 |
| AHC | 1.98 × $10^{-6}$ | 0.4144 | 0.0006 | 7.28 × $10^{-3}$ | 0.3993 | 96.4 | 0.0012 | 0.9997 |
| AHC | 3.56 × $10^{-6}$ | 0.3398 | 0.0007 | 8.74 × $10^{-3}$ | 0.3312 | 97.5 | 0.0032 | 0.9988 |
| AHC | 2.77 × $10^{-6}$ | 0.2922 | 0.0005 | 8.95 × $10^{-3}$ | 0.2836 | 97 | 0.0014 | 0.9993 |
| AHC | 3.10 × $10^{-6}$ | 0.3706 | 0.0005 | 1.19 × $10^{-2}$ | 0.3555 | 95.9 | 0.003 | 0.9989 |
| AHC | | | | | | | | |
| AHC | | | | | | | | |

TABLE 15

Octet binding affinity data for anti-VISTA monoclonal antibodies to cynomolgus monkey VISTA-ECD

| Sensor Type | Sample ID | Loading Sample ID | Conc. (nM) | Response | KD (M) | KD Error | Kon (1/Ms) | kon Error | Kdis (1/s) |
|---|---|---|---|---|---|---|---|---|---|
| AHC | cyno VISTA | 269.1 | 300 | 0.4337 | 5.98 × $10^{-9}$ | 6.35 × $10^{-11}$ | 1.28 × $10^{5}$ | 8.60 × $10^{2}$ | 7.66 × $10^{-4}$ |
| AHC | cyno VISTA | 269.1 | 50 | 0.2114 | 1.60 × $10^{-9}$ | 1.88 × $10^{-11}$ | 2.12 × $10^{5}$ | 8.44 × $10^{2}$ | 3.38 × $10^{-4}$ |
| AHC | cyno VISTA | 269.1 | 50 | 0.3383 | 4.26 × $10^{-9}$ | 1.74 × $10^{-11}$ | 1.94 × $10^{5}$ | 4.81 × $10^{2}$ | 8.27 × $10^{-4}$ |
| AHC | cyno VISTA | 321.1 | 300 | 0.4417 | 5.11 × $10^{-9}$ | 9.17 × $10^{-11}$ | 8.83 × $10^{4}$ | 6.39 × $10^{2}$ | 4.51 × $10^{-4}$ |
| AHC | cyno VISTA | 321.1 | 50 | 0.1995 | 1.47 × $10^{-9}$ | 2.70 × $10^{-11}$ | 1.41 × $10^{5}$ | 7.08 × $10^{2}$ | 2.07 × $10^{-4}$ |
| AHC | cyno VISTA | 321.1 | 50 | 0.3028 | 2.66 × $10^{-9}$ | 1.81 × $10^{-11}$ | 1.44 × $10^{5}$ | 3.84 × $10^{2}$ | 3.83 × $10^{-4}$ |
| AHC | cyno VISTA | 245.1 | 300 | 0.4338 | 3.56 × $10^{-9}$ | 5.30 × $10^{-11}$ | 1.32 × $10^{5}$ | 9.14 × $10^{2}$ | 4.68 × $10^{-4}$ |
| AHC | cyno VISTA | 245.1 | 50 | 0.2223 | 9.36 × $10^{-10}$ | 2.14 × $10^{-11}$ | 1.84 × $10^{5}$ | 8.26 × $10^{2}$ | 1.72 × $10^{-4}$ |
| AHC | cyno VISTA | 245.1 | 50 | 0.3275 | 1.66 × $10^{-9}$ | 1.23 × $10^{-11}$ | 1.97 × $10^{5}$ | 4.37 × $10^{2}$ | 3.27 × $10^{-4}$ |
| AHC | cyno VISTA | 465.1 | 300 | 0.4551 | 6.09 × $10^{-9}$ | 4.84 × $10^{-11}$ | 1.09 × $10^{5}$ | 4.85 × $10^{2}$ | 6.65 × $10^{-4}$ |
| AHC | cyno VISTA | 465.1 | 50 | 0.2082 | 2.48 × $10^{-9}$ | 2.85 × $10^{-11}$ | 1.57 × $10^{5}$ | 7.88 × $10^{2}$ | 3.88 × $10^{-4}$ |
| AHC | cyno VISTA | 465.1 | 50 | 0.3126 | 4.34 × $10^{-9}$ | 2.63 × $10^{-11}$ | 1.34 × $10^{5}$ | 4.49 × $10^{2}$ | 5.80 × $10^{-4}$ |
| AHC | cyno VISTA | 457.1 | 300 | 0.4564 | 3.32 × $10^{-9}$ | 3.77 × $10^{-11}$ | 1.40 × $10^{5}$ | 7.49 × $10^{2}$ | 4.63 × $10^{-4}$ |
| AHC | cyno VISTA | 457.1 | 50 | 0.2589 | 1.13 × $10^{-9}$ | 1.58 × $10^{-11}$ | 1.84 × $10^{5}$ | 6.02 × $10^{2}$ | 2.08 × $10^{-4}$ |
| AHC | cyno VISTA | 457.1 | 50 | 0.3166 | 3.47 × $10^{-9}$ | 2.40 × $10^{-11}$ | 1.70 × $10^{5}$ | 5.98 × $10^{2}$ | 5.89 × $10^{-4}$ |
| AHC | cyno VISTA | 173.1 | 50 | 0.3136 | 2.6 × $10^{-9}$ | 1.69 × $10^{-11}$ | 1.55 × $10^{5}$ | 3.96 × $10^{2}$ | 4.02 × $10^{-4}$ |
| AHC | cyno VISTA | 173.1 | 50 | 0.3452 | 2.6 × $10^{-9}$ | 1.84 × $10^{-11}$ | 1.62 × $10^{5}$ | 4.59 × $10^{2}$ | 4.22 × $10^{-4}$ |
| AHC | cyno VISTA | 833.1 | 50 | 0.2315 | 6.79 × $10^{-9}$ | 3.59 × $10^{-11}$ | 1.45 × $10^{5}$ | 5.49 × $10^{2}$ | 9.81 × $10^{-4}$ |
| AHC | cyno VISTA | 833.1 | 50 | 0.3314 | 5.31 × $10^{-9}$ | 2.94 × $10^{-11}$ | 1.61 × $10^{5}$ | 5.81 × $10^{2}$ | 8.54 × $10^{-4}$ |

TABLE 15-continued

| Octet binding affinity data for anti-VISTA monoclonal antibodies to cynomolgus monkey VISTA-ECD | | | | | | | | |
|---|---|---|---|---|---|---|---|---|
| Sensor Type | kdis Error | RMax | RMax Error | Kobs (1/s) | Req | Req/ Rmax(%) | Full X ^ 2 | Full R ^ 2 |
| AHC | $6.29 \times 10^{-6}$ | 0.436 | 0.0005 | $3.92 \times 10^{-2}$ | 0.4275 | 98 | 0.024 | 0.9882 |
| AHC | $3.75 \times 10^{-6}$ | 0.2352 | 0.0004 | $1.09 \times 10^{-2}$ | 0.2279 | 96.9 | 0.0018 | 0.9985 |
| AHC | $2.67 \times 10^{-6}$ | 0.3821 | 0.0004 | $1.05 \times 10^{-2}$ | 0.3521 | 92.1 | 0.0024 | 0.9992 |
| AHC | $7.41 \times 10^{-6}$ | 0.4414 | 0.0007 | $2.69 \times 10^{-2}$ | 0.434 | 98.3 | 0.0351 | 0.9859 |
| AHC | $3.66 \times 10^{-6}$ | 0.2532 | 0.0007 | $7.25 \times 10^{-3}$ | 0.246 | 97.1 | 0.0016 | 0.9989 |
| AHC | $2.40 \times 10^{-6}$ | 0.357 | 0.0005 | $7.57 \times 10^{-3}$ | 0.339 | 94.9 | 0.0018 | 0.9995 |
| AHC | $6.17 \times 10^{-6}$ | 0.4308 | 0.0005 | $3.99 \times 10^{-2}$ | 0.4257 | 98.8 | 0.0255 | 0.9858 |
| AHC | $3.86 \times 10^{-6}$ | 0.2571 | 0.0005 | $9.38 \times 10^{-3}$ | 0.2524 | 98.2 | 0.0023 | 0.9986 |
| AHC | $2.31 \times 10^{-6}$ | 0.3561 | 0.0003 | $1.02 \times 10^{-2}$ | 0.3447 | 96.8 | 0.002 | 0.9994 |
| AHC | $4.37 \times 10^{-6}$ | 0.4582 | 0.0004 | $3.34 \times 10^{-2}$ | 0.4491 | 98 | 0.0128 | 0.9948 |
| AHC | $4 \times 10^{6}$ | 0.2564 | 0.0007 | $8.21 \times 10^{-3}$ | 0.2443 | 95.3 | 0.002 | 0.9985 |
| AHC | $2.93 \times 10^{-6}$ | 0.389 | 0.0007 | $7.26 \times 10^{-3}$ | 0.3579 | 92 | 0.0026 | 0.9992 |
| AHC | $4.64 \times 10^{-6}$ | 0.4552 | 0.0004 | $4.24 \times 10^{-2}$ | 0.4503 | 98.9 | 0.0163 | 0.9918 |
| AHC | $2.83 \times 10^{-6}$ | 0.2994 | 0.0004 | $9.39 \times 10^{-3}$ | 0.2927 | 97.8 | 0.0016 | 0.9992 |
| AHC | $3.51 \times 10^{-6}$ | 0.3606 | 0.0006 | $9.09 \times 10^{-3}$ | 0.3372 | 93.5 | 0.0038 | 0.9987 |
| AHC | $2.4 \times 10^{-6}$ | 0.3623 | 0.0004 | $8.14 \times 10^{-3}$ | 0.3444 | 95.1 | 0.0018 | 0.9994 |
| AHC | $2.72 \times 10^{-6}$ | 0.3917 | 0.0005 | $8.52 \times 10^{-3}$ | 0.3723 | 95.1 | 0.0028 | 0.9993 |
| AHC | $3.6 \times 10^{-6}$ | 0.2911 | 0.0006 | $8.20 \times 10^{-3}$ | 0.2563 | 88 | 0.0019 | 0.9988 |
| AHC | $3.59 \times 10^{-6}$ | 0.3917 | 0.0007 | $8.90 \times 10^{-3}$ | 0.3541 | 90.4 | 0.004 | 0.9987 |

The effect of ligand loading levels in the Octet assay were evaluated under conditions that provide a signal shift in the association step of 0.2 and 0.6 nm. In general, $K_D$ values were 2-3-fold lower when ligand loading concentrations on the sensor were reduced.

Effect of pH on antibody affinity: To identify antibodies that bound to VISTA at pH 7.4, consistent with cell surface expressed VISTA, but dissociated from the receptor at endosomal pH, Octet was performed with ligand association measured at pH 7.4 and dissociation measured at pH 6. Table 16 shows the average $K_{on}$(1/Ms) and $K_{dis}$ (1/s) for 7 antibodies at pH 7.4 in comparison to the on-rate (pH 7.4) and off-rate (pH 6) for the same antibodies in a single experiment. Results are shown in Table. The dissociation constant for several antibodies increases at pH 6, suggesting that these antibodies will bind tightly to cell surface expressed VISTA at pH 7.4 but will dissociate from endosomal VISTA at pH<6.

TABLE 16

| Ratio of Kdis at pH 6 versus pH 7.4. | | | | | | |
|---|---|---|---|---|---|---|
| Antibody | pH 7.4 Mean $K_{on}$ | pH 7.4 Mean $K_{dis}$ | pH 7.4 $K_{on}$ | pH 6 $K_{dis}$ | Ratio $K_{on}$ (pH 6/pH 7.4) | Ratio $K_{dis}$ (pH 6/pH 7.4) |
| 269.1 | $2.17 \times 10^{5}$ | $3.74 \times 10^{-4}$ | $1.65 \times 10^{5}$ | $1.73 \times 10^{-3}$ | 0.76 | 4.62 |
| 321.1 | $1.56 \times 10^{5}$ | $2.09 \times 10^{-4}$ | $1.35 \times 10^{5}$ | $1 \times 10^{-7}$ | 0.87 | 0.00 |
| 245.1 | $2.27 \times 10^{5}$ | $2.58 \times 10^{-4}$ | $1.58 \times 10^{5}$ | $1 \times 10^{-7}$ | 0.70 | 0.00 |
| 465.1 | $1.82 \times 10^{5}$ | $3.36 \times 10^{-4}$ | $1.54 \times 10^{5}$ | $7.32 \times 10^{-4}$ | 0.85 | 2.18 |
| 457.1 | $2.31 \times 10^{5}$ | $2.21 \times 10^{-4}$ | $1.67 \times 10^{5}$ | $1.39 \times 10^{-4}$ | 0.72 | 0.63 |
| 173.1 | $1.55 \times 10^{5}$ | $2.42 \times 10^{-4}$ | $1.33 \times 10^{5}$ | $1.62 \times 10^{-5}$ | 0.86 | 0.07 |
| 833.1 | $2.29 \times 10^{5}$ | $4.86 \times 10^{-4}$ | $1.28 \times 10^{5}$ | $2.05 \times 10^{-3}$ | 0.56 | 4.22 |

Full kinetic analysis: Full kinetic analysis of binding affinities was performed by BLI using the Octet system over a 2-fold serial dilution of analyte concentrations from 0-500 nM. The equilibrium binding constants were calculated by using the steady state analysis tool in the Octet System Data Analysis Software. Analysis was performed on binding traces with $0.05<R_{eq}<0.5$ nm. Antibody binding affinities estimated in this way are shown in FIG. 4A-4G and Table 17 and are consistent with Octet scouting studies.

TABLE 17

Full kinetic analysis of antibody affinities

| Sensor Type | Loading Sample ID | Sample ID (Analyte) | Conc. (nM) | $K_D$ (M) | $k_{on}$(1/Ms) | $k_{dis}$(1/s) | Full X ^ 2 | Full R ^ 2 |
|---|---|---|---|---|---|---|---|---|
| AHC | 321.1 at 25 ug/ml | hu.VISTA | 125-15.6 | $4.01 \times 10^{-9}$ | $1.08 \times 10^{5}$ | $4.33 \times 10^{-4}$ | 0.1392 | 0.9971 |
| AHC | 245.1 at 25 ug/ml | hu.VISTA | 125-15.6 | $2.17 \times 10^{-9}$ | $1.39 \times 10^{5}$ | $3.01 \times 10^{-4}$ | 0.1105 | 0.9986 |
| AHC | 457.1 at 25 ug/ml | hu.VISTA | 125-15.6 | $1.96 \times 10^{-9}$ | $1.39 \times 10^{5}$ | $2.72 \times 10^{-4}$ | 0.1294 | 0.9987 |
| AHC | 465.1 at 25 ug/ml | hu.VISTA | 250-15.6 | $1.72 \times 10^{-9}$ | $1.45 \times 10^{5}$ | $2.49 \times 10^{-4}$ | 0.2188 | 0.9987 |
| AHC | 173.1 at 25 ug/ml | hu.VISTA | 250-15.6 | $7.06 \times 10^{-10}$ | $1.71 \times 10^{5}$ | $1.21 \times 10^{-4}$ | 0.0791 | 0.999 |
| AHC | 150.1 at 25 ug/ml | hu.VISTA | 100-13 | $7.97 \times 10^{-10}$ | $1.91 \times 10^{5}$ | $1.53 \times 10^{-4}$ | | |
| AHC | 474.1 at 25 ug/ml | hu.VISTA | 87-16.5 | $7.81 \times 10^{-10}$ | $2.60 \times 10^{5}$ | $2.03 \times 10^{-4}$ | | |

Example 5: Determination of Antibody Affinity by ELISA

Nickel-coated 96-well ELISA plates (Thermo Scientific) or Maxisorb 96-well polystyrene ELISA plates were coated overnight at 4° C. with 50 μL of a 0.5-1 μg/mL solution of His-tagged VISTA protein (SinoBiological, Met1-Ala194 produced in HE293 cells) in 0.1M $NaHCO_3$ pH 9.6. All subsequent incubations were performed at room temperature. Wells were washed 3 times with PBST (0.05% Tween 20) and blocked for 2 h with 200 μL 5% BSA in PBST. Anti-VISTA antibodies were diluted in 0.5% BSA in PBST to 2-23 μg/mL, and 5-fold serial dilutions were made from 10-0.003 μg/mL in 0.5% BSA/PBST. Each antibody dilution was incubated at 50-100 L/well in the ELISA plate for 1 h, after which plates were washed 3 times with PBST and incubated with a 1:20,000 dilution of Biotin SP AffiniPure Donkey Anti-Human IgG (H+L) polyclonal antibody (Jackson ImmunoResearch, 50-100 μL/well) for 1 h. Wells were washed 3 times with PBST, and the plates were incubated with 50-100 μL of a 1:200 dilution of Streptavidin-HRP (R&D Systems) for 30 min. Wells were washed 3 times with PBST and developed with 100 μL 1-Step Ultra Fast TMB Substrate (Thermo Scientific) for 2 minutes. The reaction was stopped with 100 μL 2N $H_2SO_4$, and plate well absorbance was measured at 450 nm (Biotek ELx808).

For human VISTA binding data, $EC_{50}$ values were calculated from nonlinear regression of log-transformed dose-response data. FIGS. 5A-5D show dose response ELISA data for each anti-VISTA antibody on human VISTA, and Table 18 provides associated $EC_{50}$ values. All the antibodies demonstrate potent binding to human VISTA by ELISA with low nanomolar $EC_{50}$.

For monkey and mouse VISTA binding, a single end-point determination was made at 1, 2 or 23 μg/mL. Table 19 provides endpoint absorbance for each antibody on human, monkey, and mouse VISTA. All antibodies bind equivalently to human and monkey VISTA by this method. None of the antibodies demonstrate appreciable binding to mouse VISTA, even at 23 μg/mL.

TABLE 18

EC50 values for anti-VISTA antibodies on human VISTA as measured by ELISA.

| Antibody | $EC_{50}$ (μg/mL) | $EC_{50}$ (nM) |
|---|---|---|
| 269.1 | 0.475 | 3.2 |
| 321.1 | 0.230 | 1.6 |
| 245.1 | 0.139 | 0.9 |
| 245.4 | 0.254 | 1.7 |
| 465.1 | 0.619 | 4.2 |
| 465.4 | 1.729 | 11.7 |
| 457.1 | 0.394 | 2.7 |
| 173.1 | 0.306 | 2.1 |
| 173.4 | 0.808 | 5.5 |
| 833.1 | 0.074 | 0.5 |
| 150.1 | 0.01 | 0.07 |
| 474.1 | 0.008 | 0.06 |
| 80 | 0.008 | 0.055 |
| 85 | 0.009 | 0.059 |
| 87 | 0.009 | 0.063 |
| 91 | 0.012 | 0.078 |
| 92 | 0.009 | 0.060 |

TABLE 19

Endpoint absorbance for anti-VISTA antibodies on human, mouse, and monkey VISTA by ELISA.

| | 2 μg/mL anti-VISTA antibody | | 23 μg/mL anti-VISTA antibody |
|---|---|---|---|
| Antibody No. | Human VISTA | Cyno VISTA | Mouse VISTA |
| 269.1 | 2.977* | 1.787* | 0.079 |
| 321.1 | 1.977 | 1.893 | 0.083 |
| 245.1 | 1.922 | 1.879 | 0.075 |
| 465.1 | 2.006 | 1.970 | 0.100 |

TABLE 19-continued

Endpoint absorbance for anti-VISTA antibodies on human, mouse, and monkey VISTA by ELISA.

| | 2 μg/mL anti-VISTA antibody | | 23 μg/mL anti-VISTA antibody |
|---|---|---|---|
| Antibody No. | Human VISTA | Cyno VISTA | Mouse VISTA |
| 457.1 | 2.037 | 1.998 | 0.082 |
| 173.1 | 2.103 | 1.874 | 0.079 |
| 833.1 | 2.020 | 1.885 | ND |

*Tested at 1 μg/mL.

Example 6: Determination of Antibody Affinity by ELISA

Nickel coated 96-well ELISA plate (Thermo Scientific) or Maxisorb 96-well polystyrene ELISA plates were coated overnight at 4 deg C. with 50 μL of a 0.5-1 μg/mL solution of His-tag VISTA protein (SinoBiological, Met1-Ala194 produced in HE293 cells) in 0.1M $NaHCO_3$ pH 9.6. All subsequent incubations were performed at room temperature. Wells were washed 3 times with PBST (0.05% Tween 20) and blocked for 2 h with 200 μL 5% BSA in PBST. Anti-VISTA antibodies were diluted in 0.5% BSA in PBST to 2-23 μg/mL, and 3.5- to 5-fold serial dilutions were made from 10 μg/mL-0.05 ng/mL in 0.5% BSA/PBST. Each antibody dilution was incubated (50-100 μL/well) in the ELISA plate for 1 h, after which plates were washed 3 times with PBST and incubated with a 1:20,000 dilution of Biotin SP AffiniPure Donkey Anti-Human IgG (H+L) polyclonal antibody (Jackson ImmunoResearch, 50-100 μL/well) for 1 h. Wells were washed 3 times with PBST, and the plates were incubated with 50-100 μL of a 1:200 dilution of Streptavidin-HRP (R&D Systems) for 30 min. Wells were washed 3 times with PBST and developed with 100 μL 1-Step Ultra Fast TMB Substrate (Thermo Scientific) for 1.5-2 minutes. The reaction was stopped with 100 μL 2N $H_2SO_4$, and plate well absorbance was measured at 450 nm (CLARIOstar microplate reader).

Figure 1A:
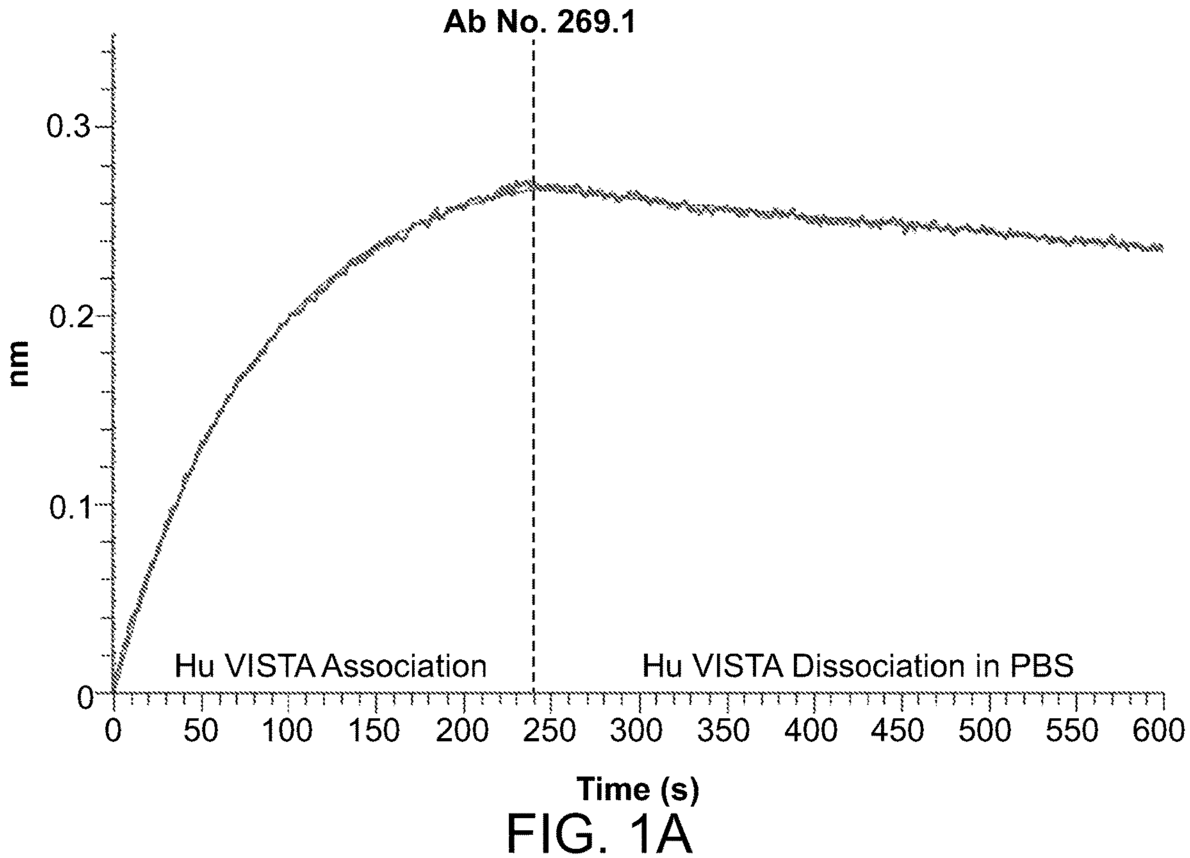
FIGS. 1A-1N. Octet sensorgrams measuring affinity of anti-VISTA antibodies No. 269.1 (FIG. 1A), No. 321.1 (FIG. 1B), No. 245.1 (FIG. 1C), No. 465.1 (FIG. 1D), No. 457.1 (FIG. 1E), No. 173.1 (FIG. 1F), No. 833.1 (FIG. 1G), No. 150.1 (FIG. 1H), No. 474.1 (FIG. 1I), No. 80 (FIG. 1J), No. 85 (FIG. 1K), No. 87 (FIG. 1L), No. 91 (FIG. 1M) and No. 92 (FIG. 1N) to human VISTA. Antibody affinities were measured using biolayer interferometry on the Octet Red 96 (ForteBio) system. Sensorgrams showing antigen (his-tagged human VISTA Met 1 to Ala 194) association and dissociation on biosensor (anti-human IgG Fc capture dip and read sensors) immobilized anti-VISTA antibodies.
Figure 1B:
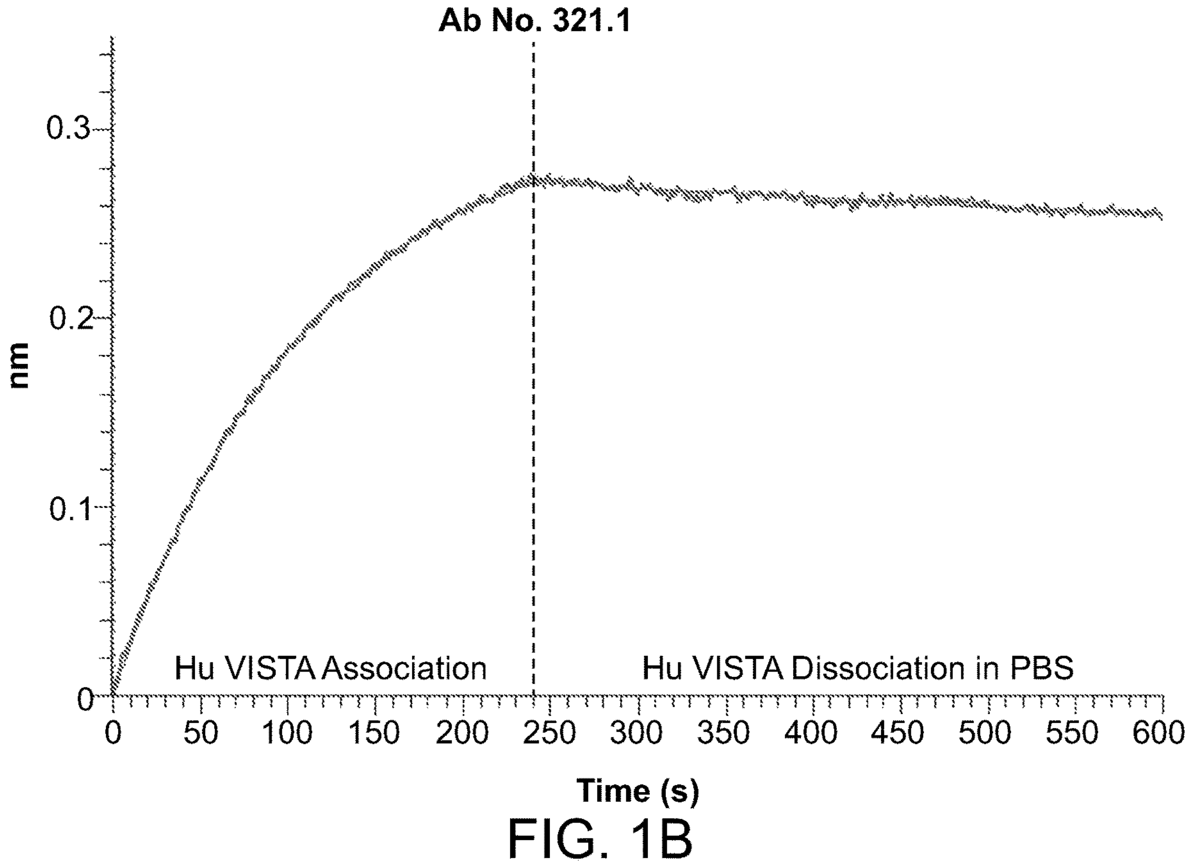
Figure 1C:
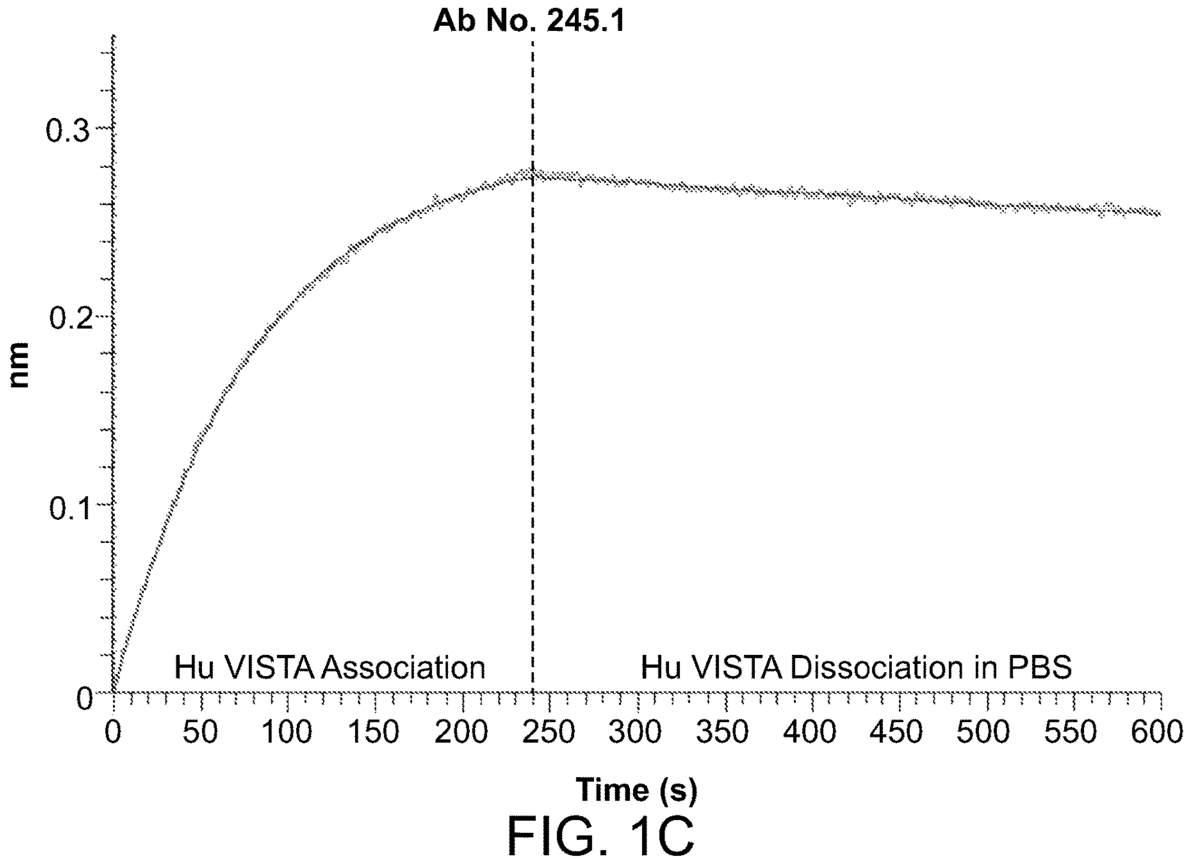
Figure 1D:
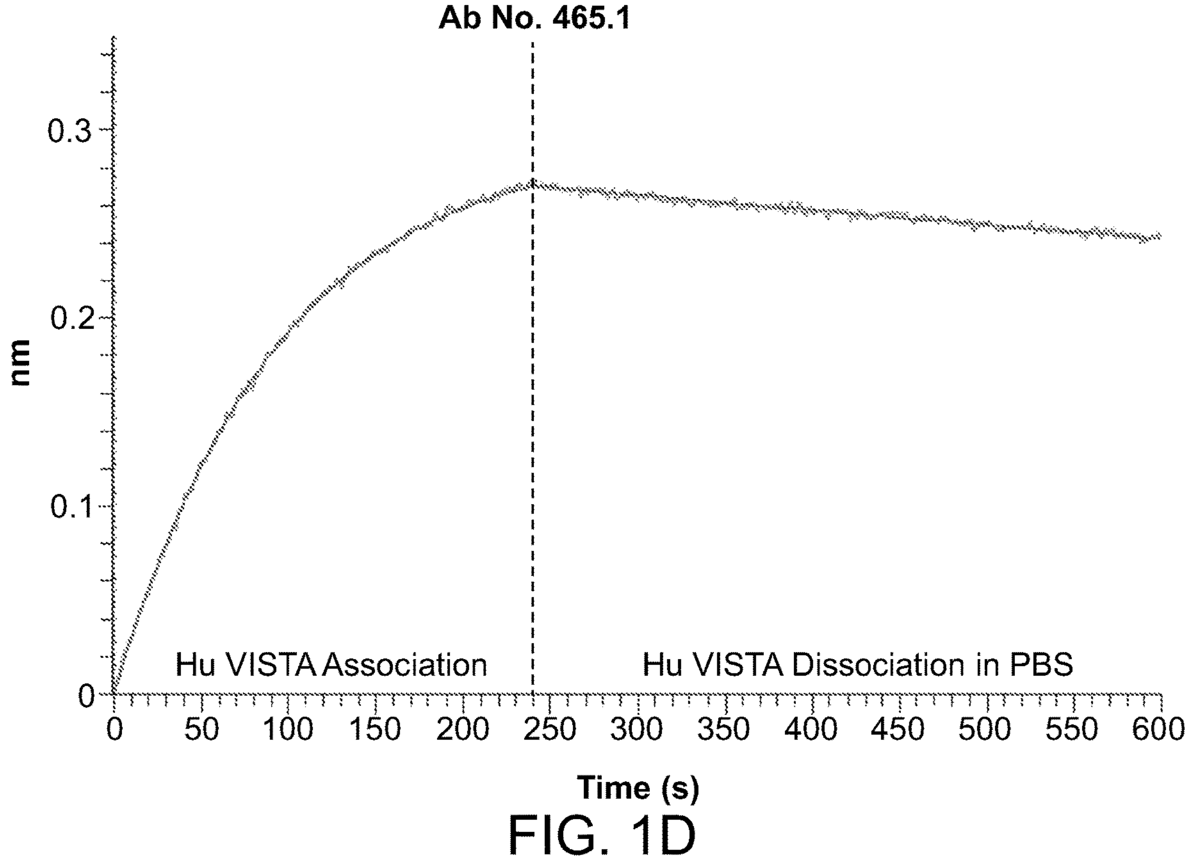
Figure 1E:
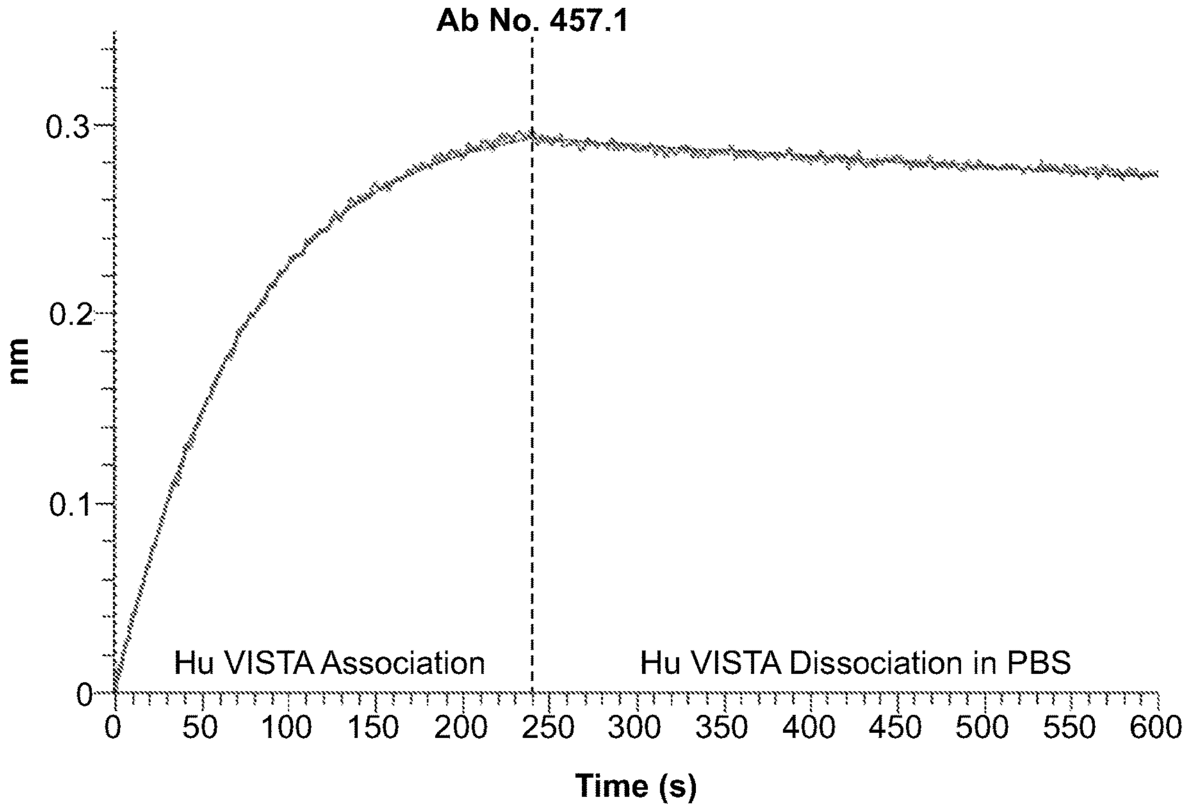
Figure 1F:
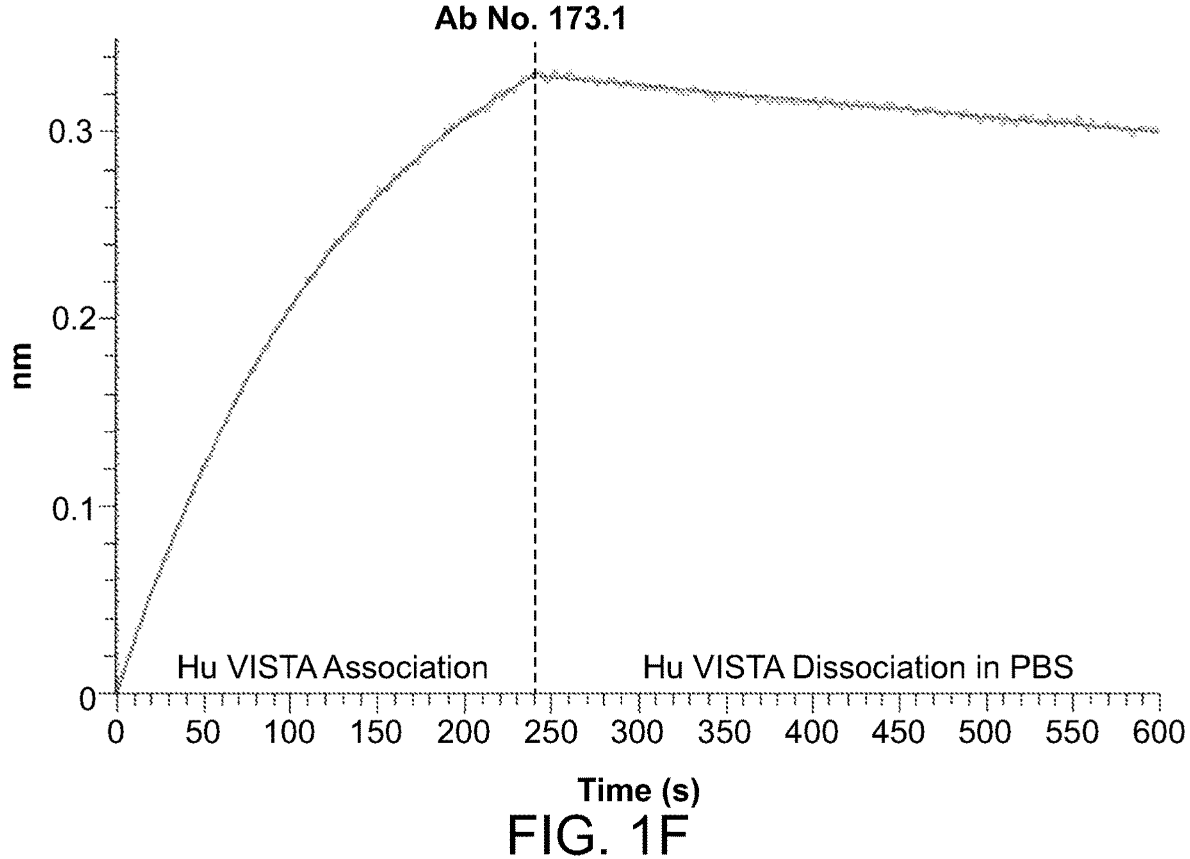
Figure 1G:
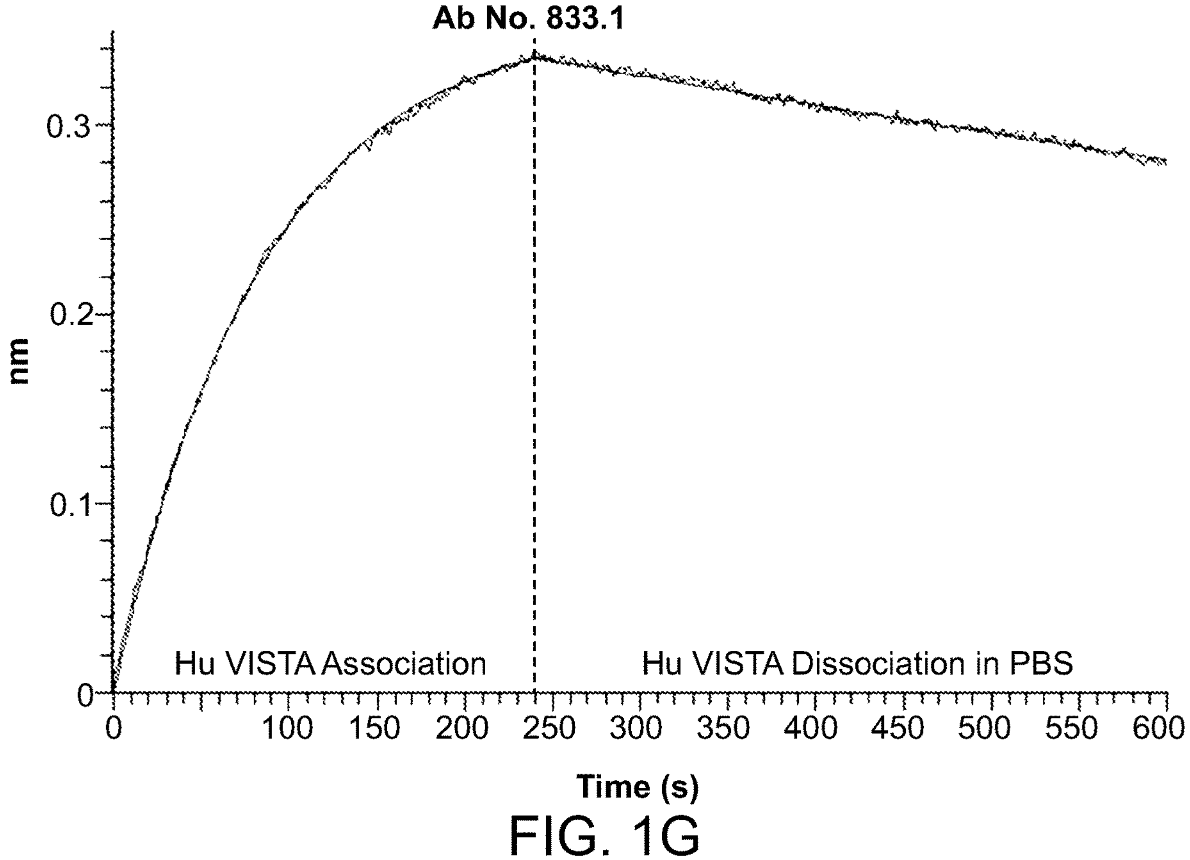
Figure 1H:
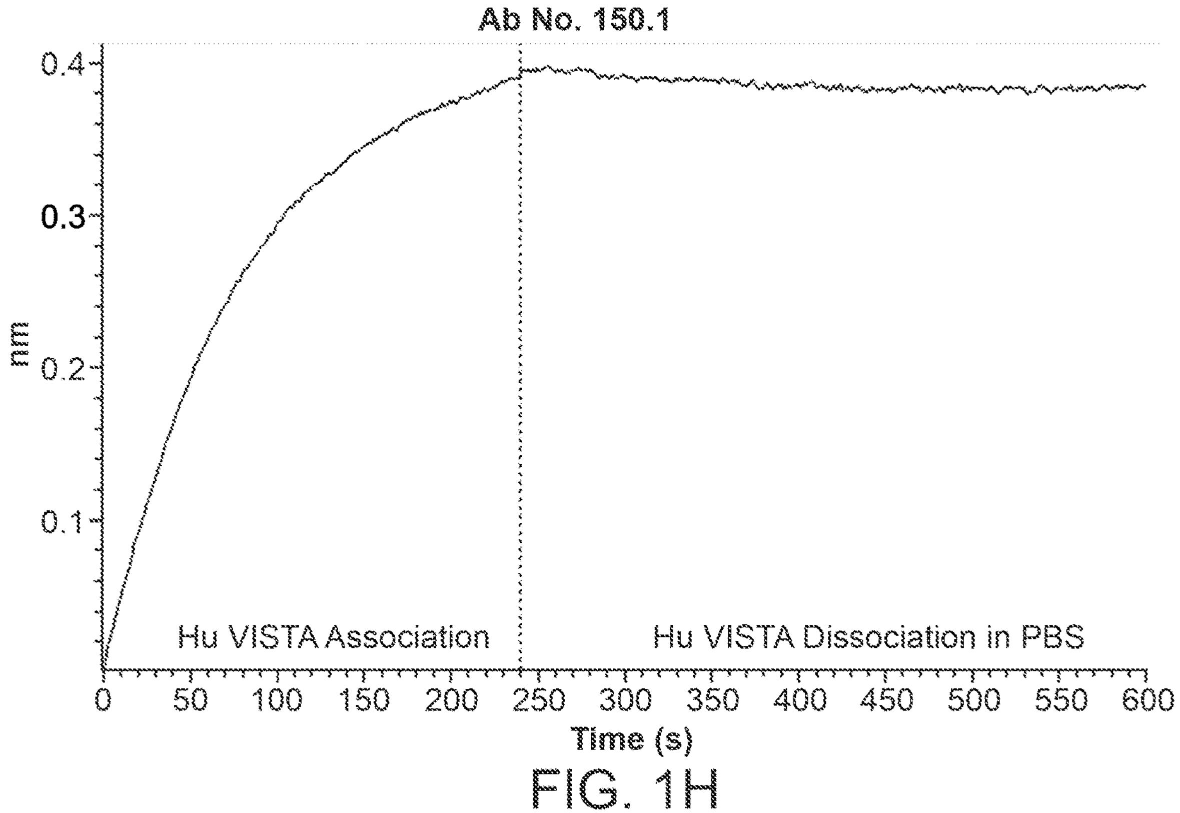
Figure 1I:
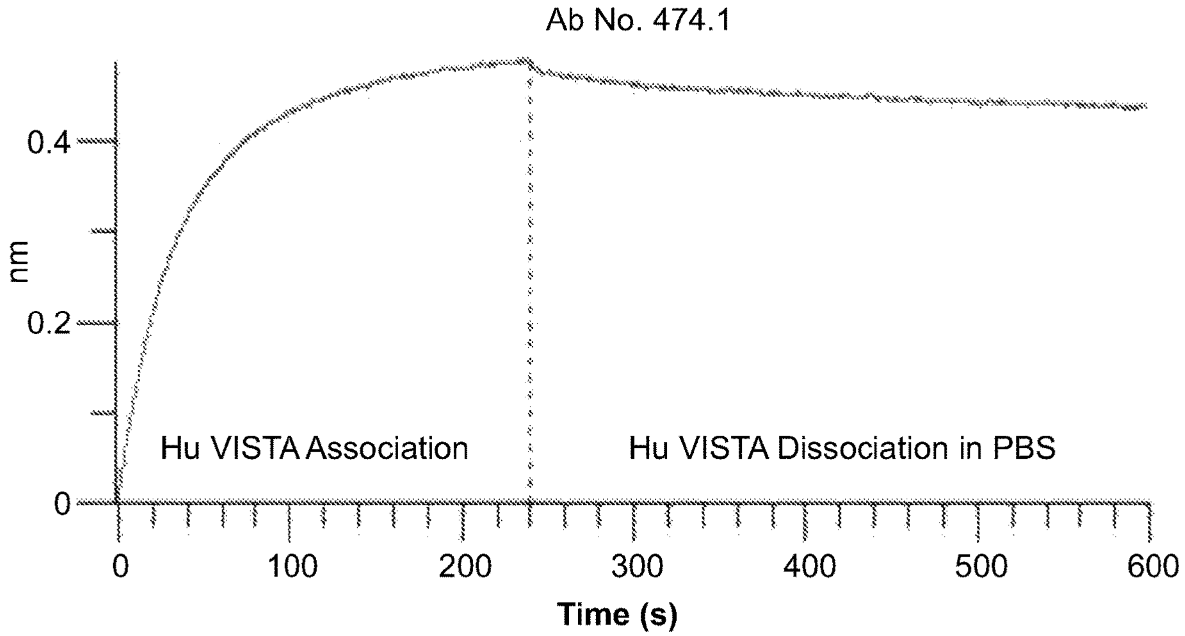
Figure 1J:
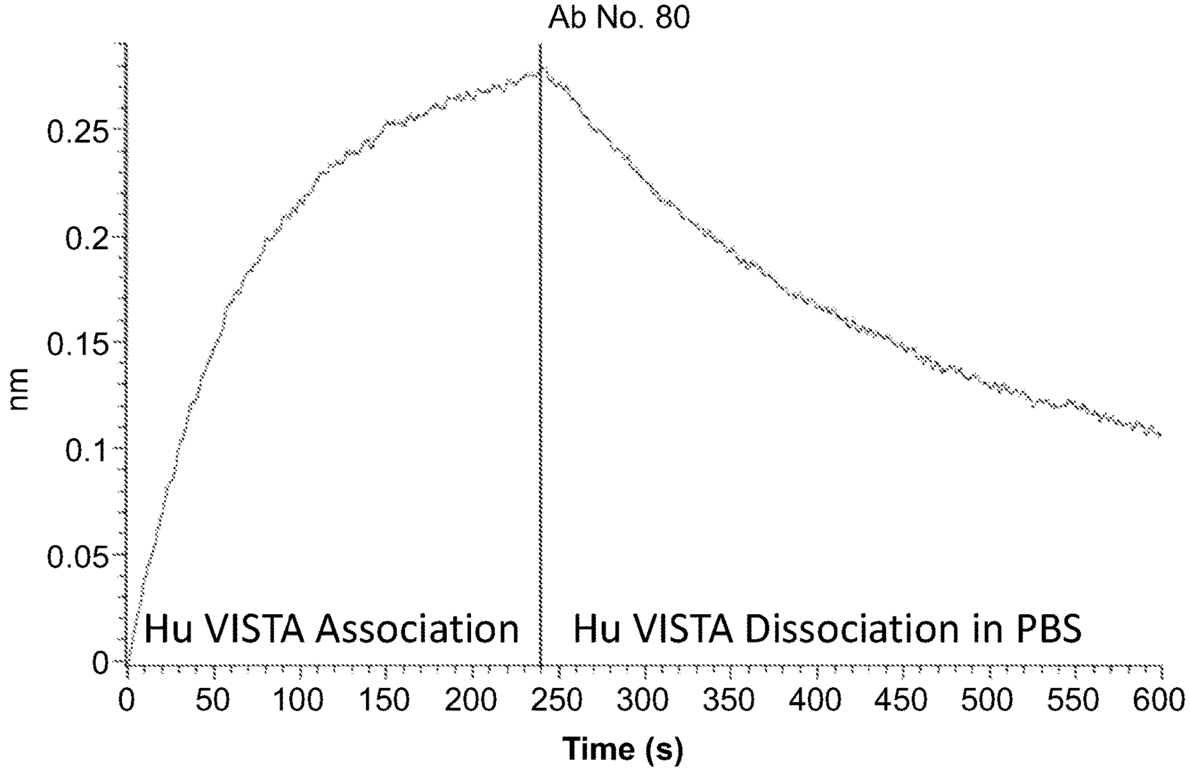
Figure 1K:
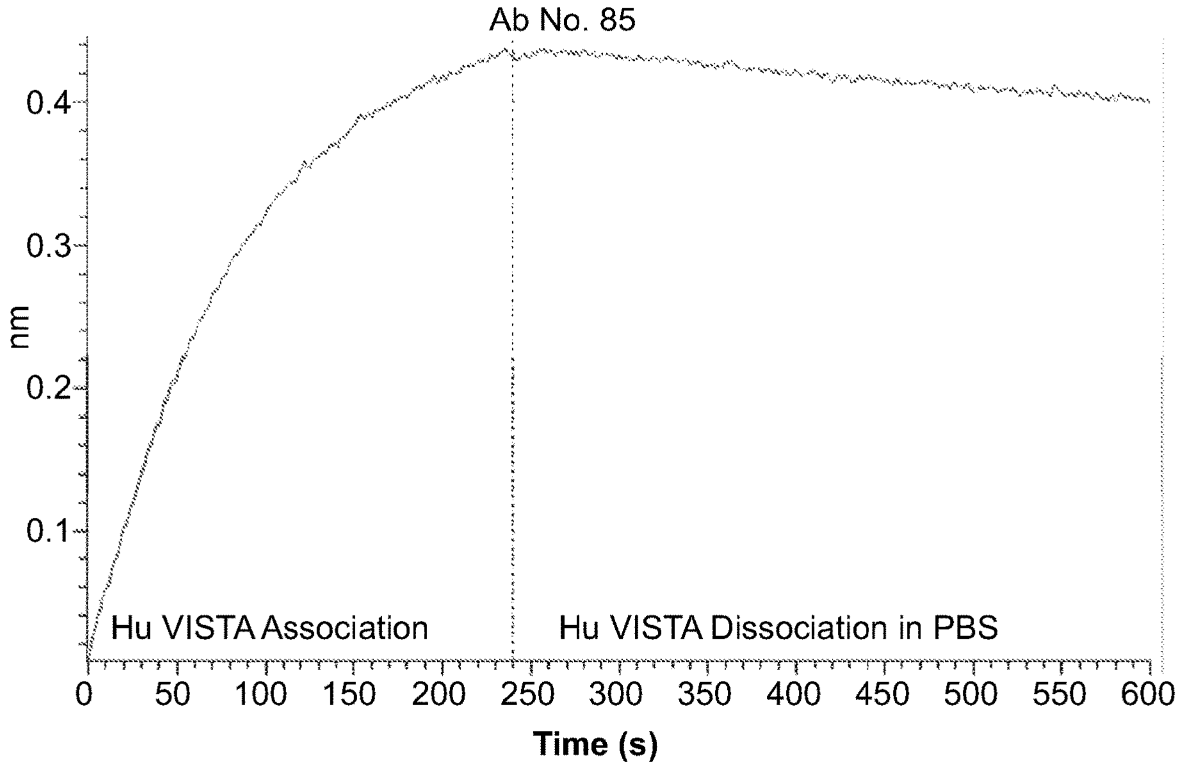
Figure 1L:
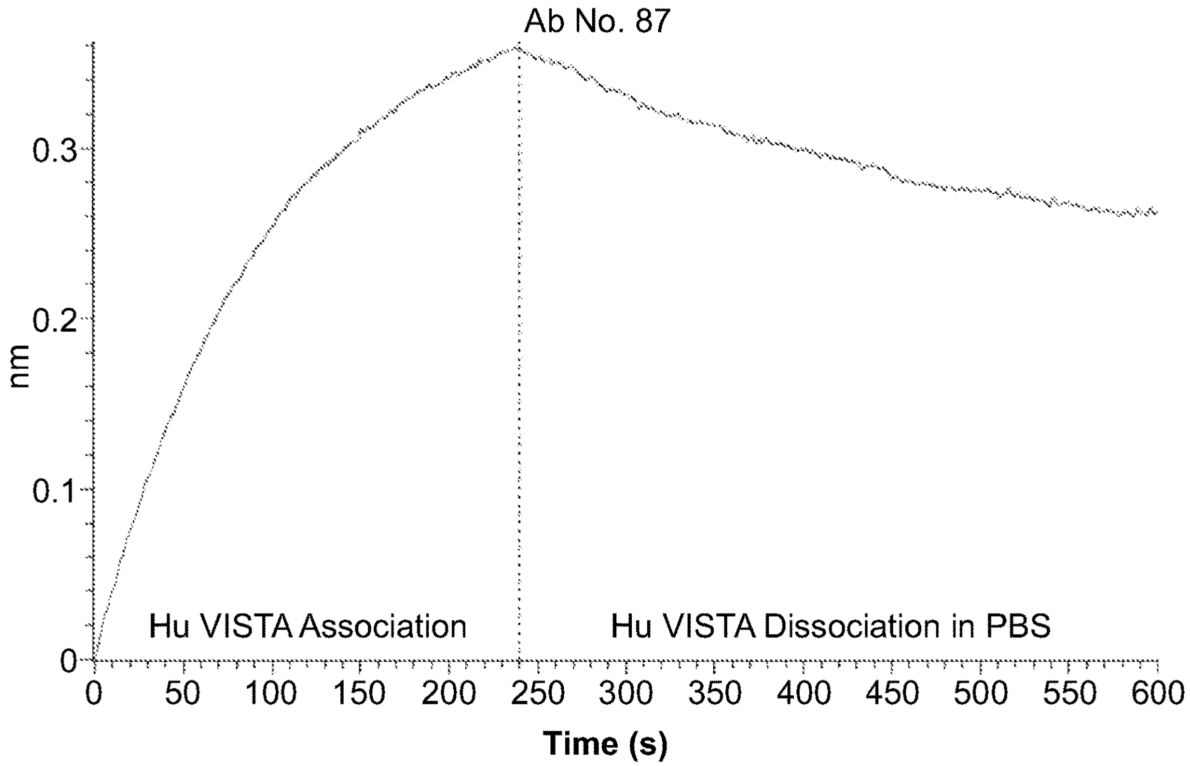
Figure 1M:
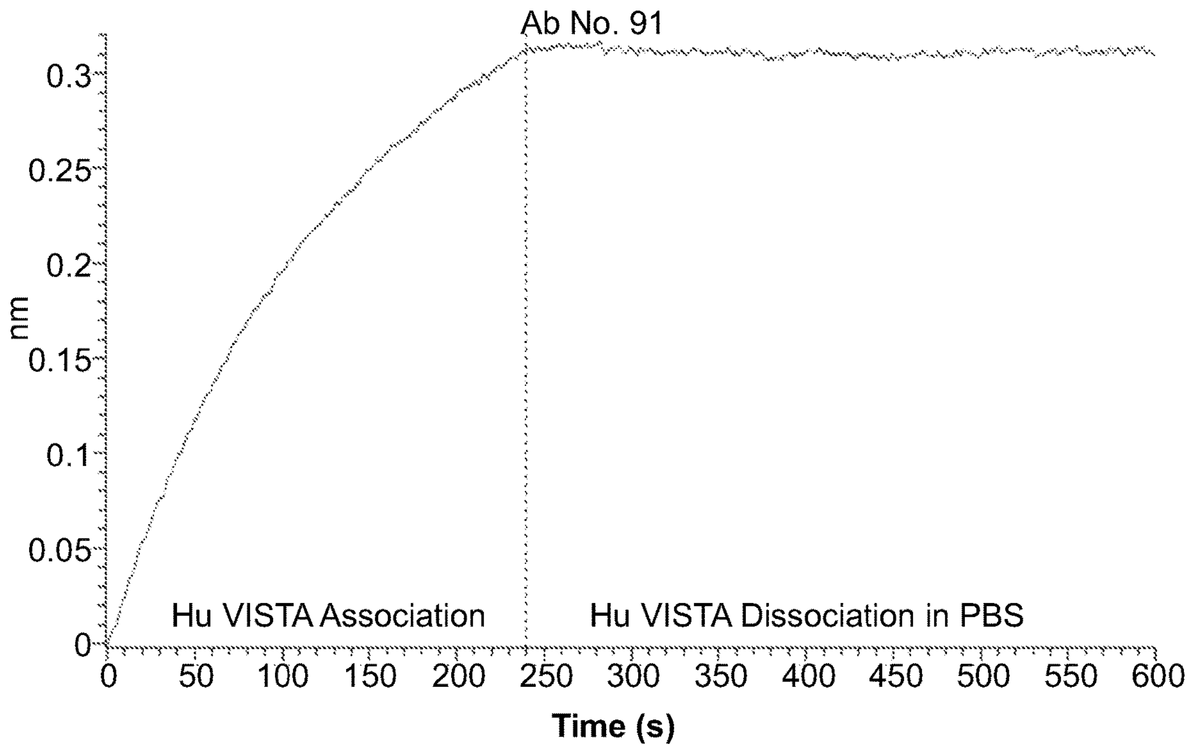
Figure 1N:
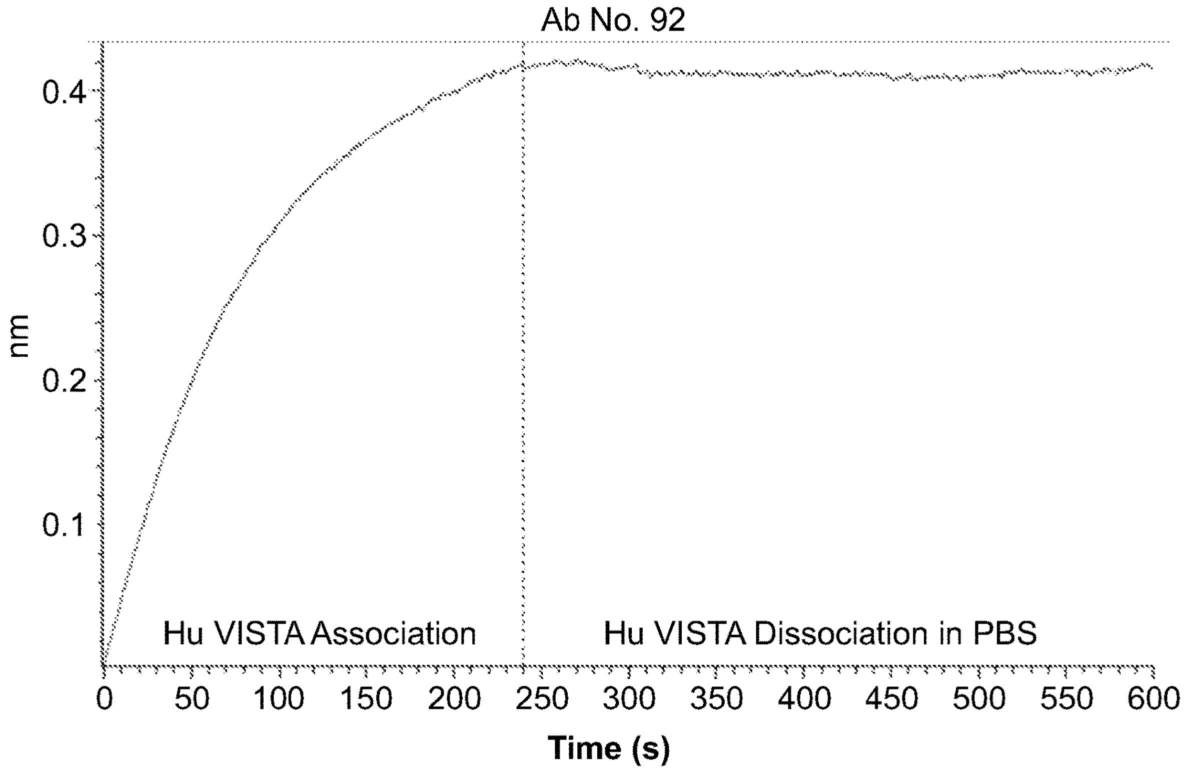
Figure 2A:
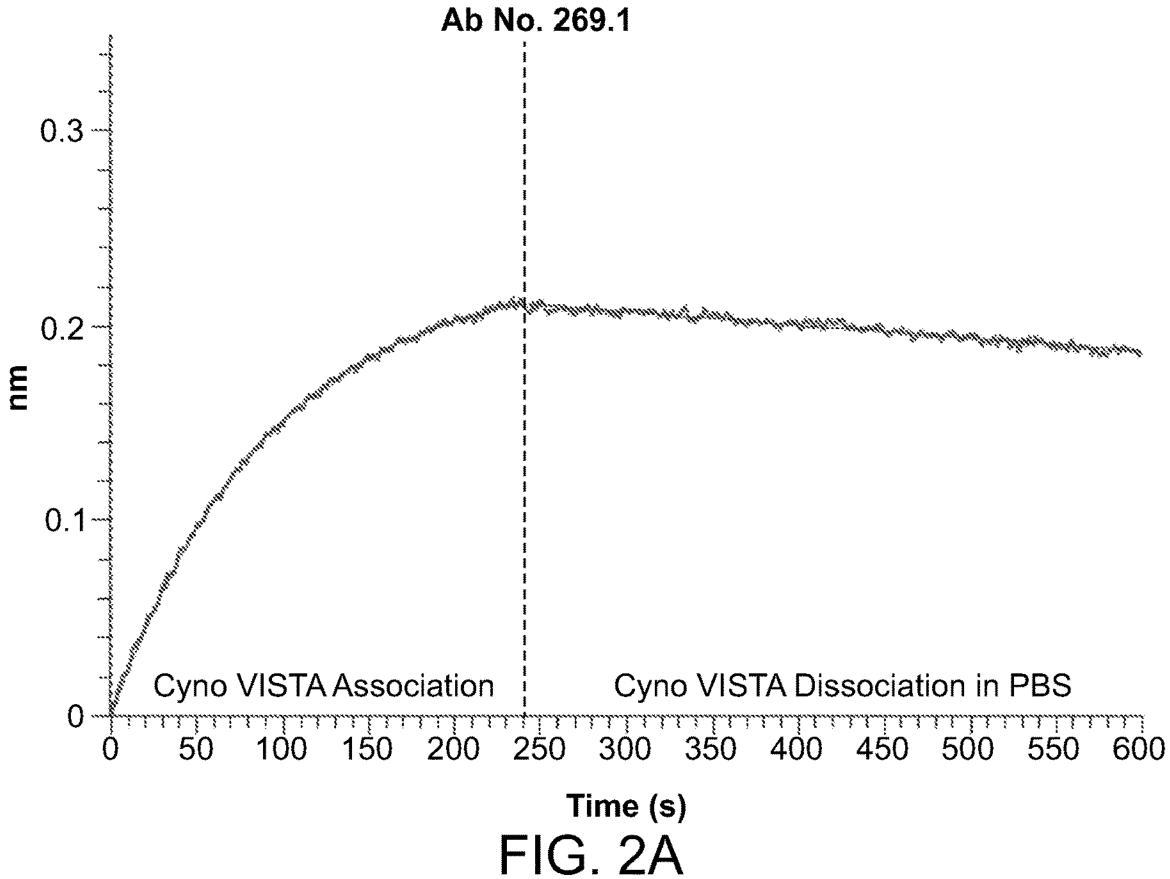
FIGS. 2A-2G. Octet sensorgrams measuring affinity of anti-VISTA antibodies No. 269.1 (FIG. 2A), No. 321.1 (FIG. 2B), No. 245.1 (FIG. 2C), No. 465.1 (FIG. 2D), No. 457.1 (FIG. 2E), No. 173.1 (FIG. 2F) and No. 833.1 (FIG. 2G) to monkey VISTA. Antibody affinities were measured using biolayer interferometry on the Octet Red 96 (ForteBio) system. Sensorgrams showing antigen (his-tagged cynomolgus monkey VISTA Met 1 to Ala 194) association and dissociation on biosensor (anti-human IgG Fc capture dip and read sensors) immobilized anti-VISTA antibodies.
Figure 2B:
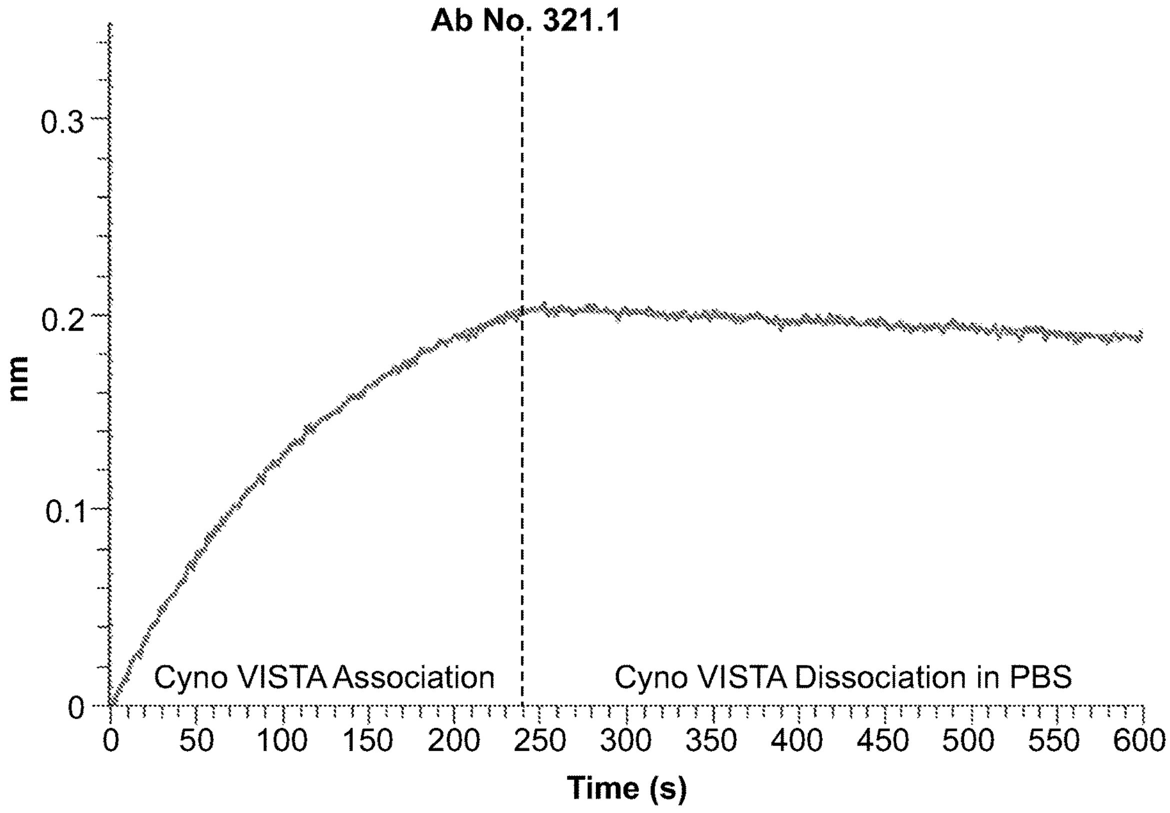
Figure 2C:
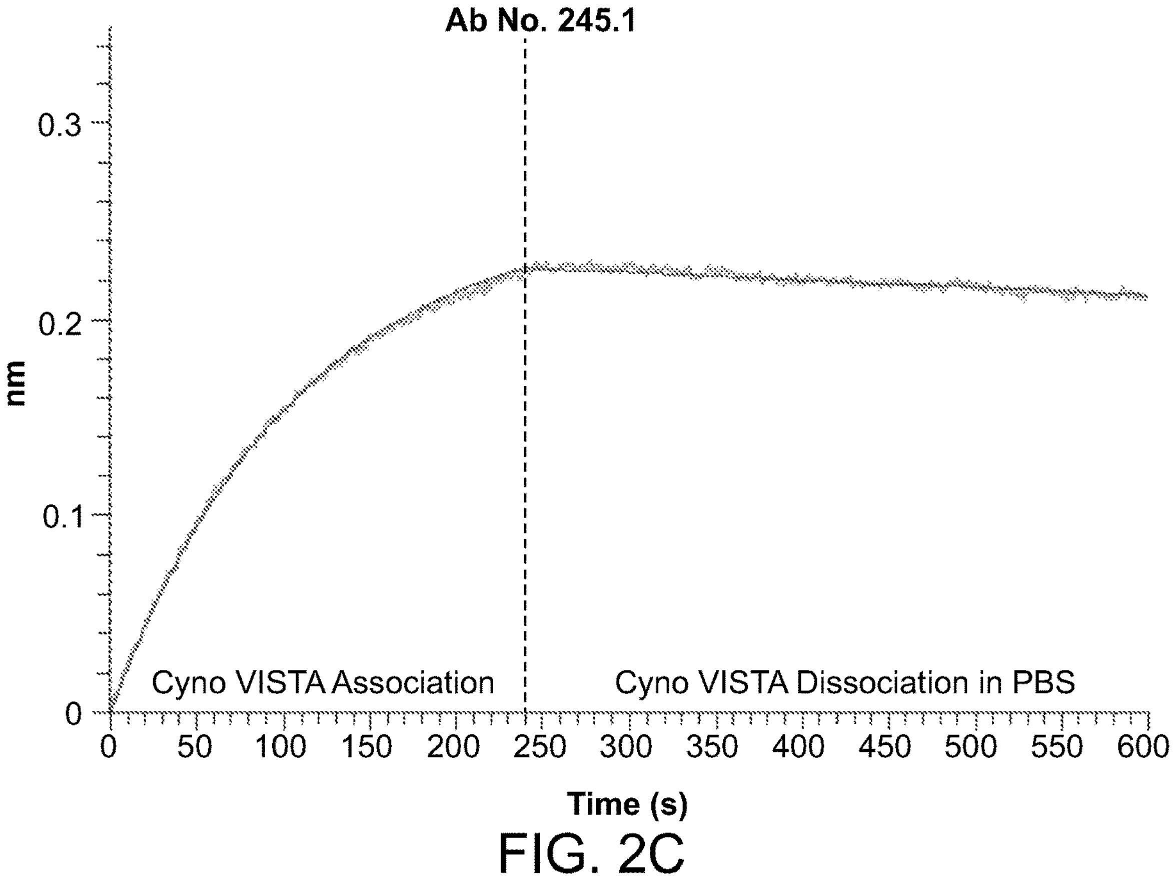
Figure 2D:
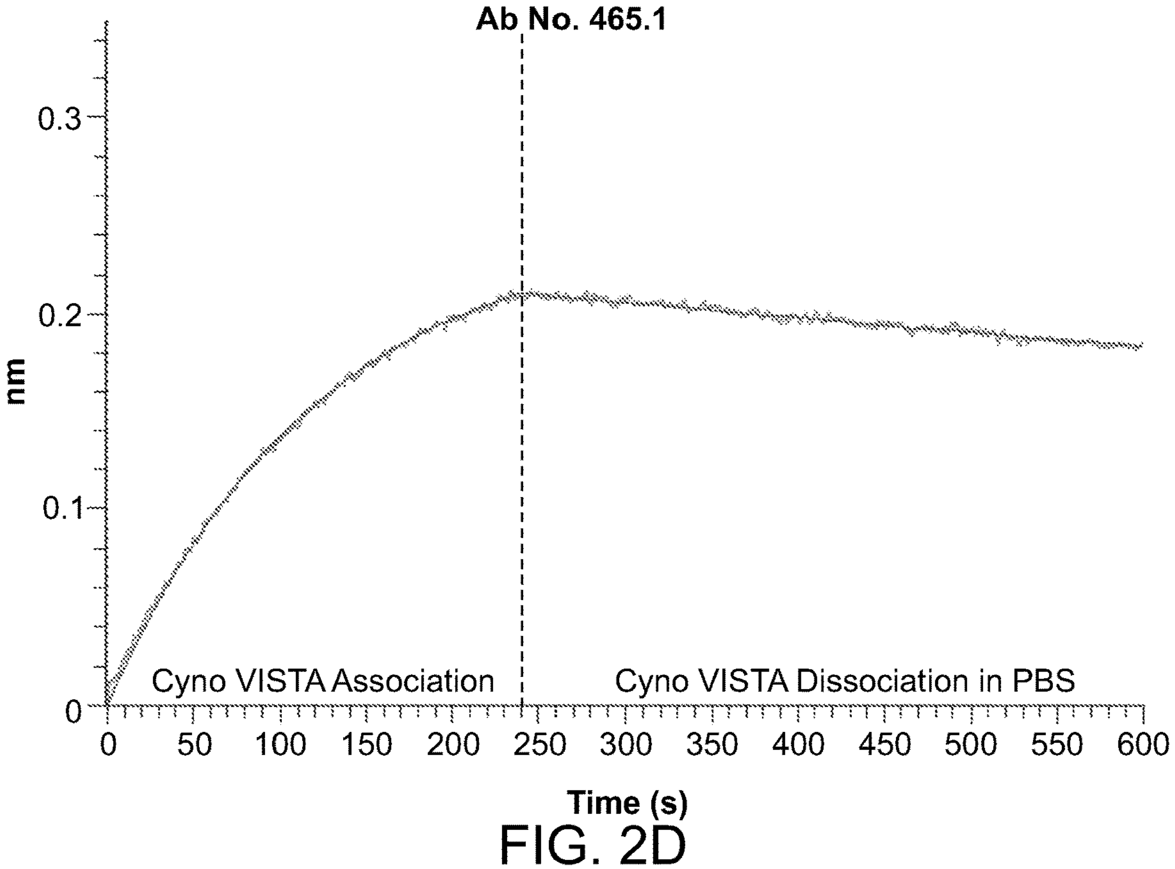
Figure 2E:
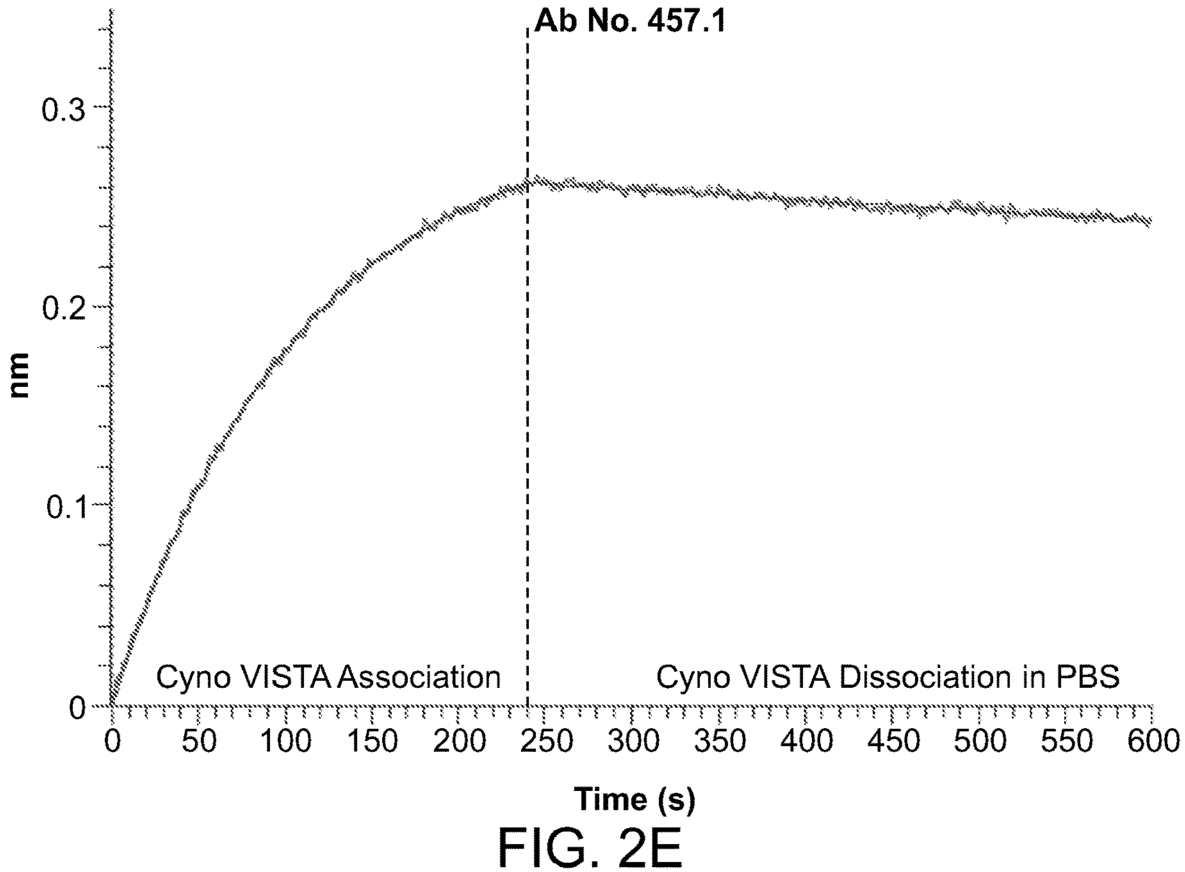
Figure 2F:
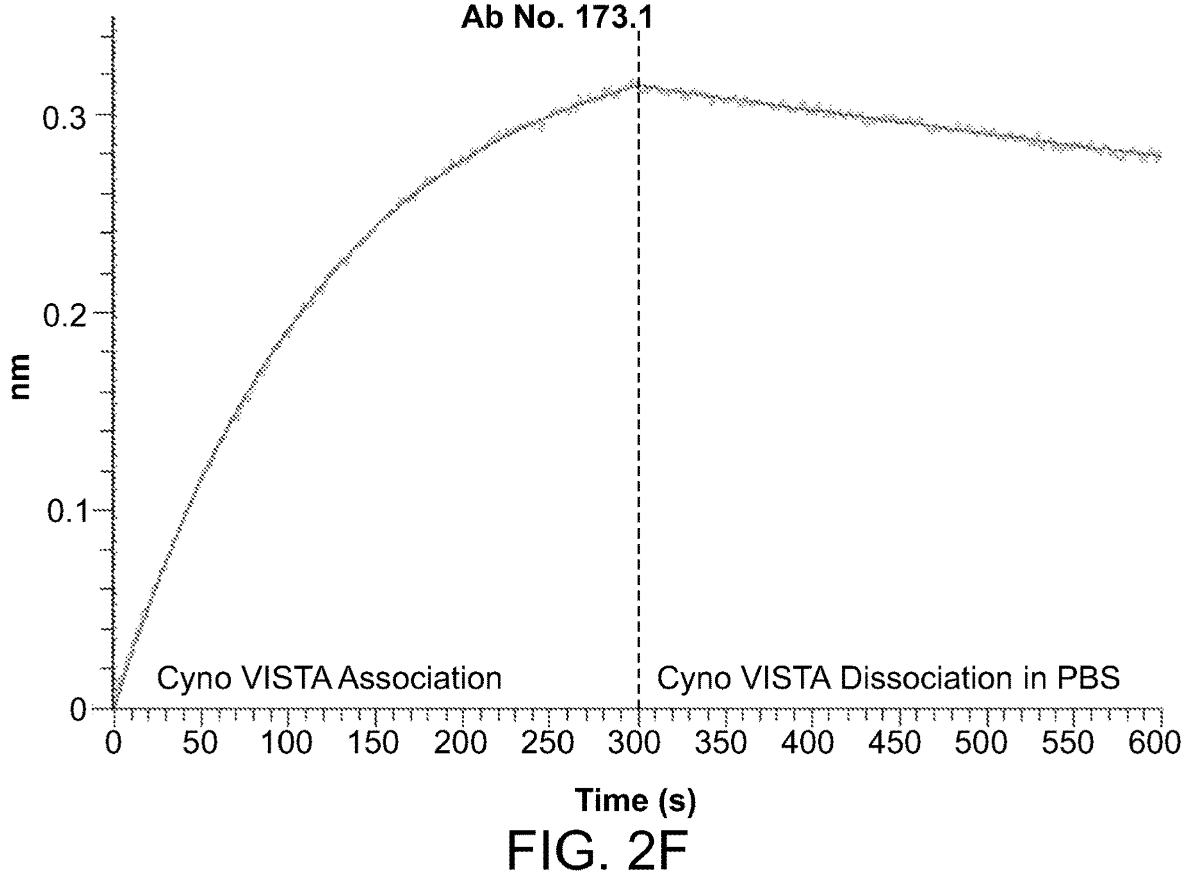
Figure 2G:
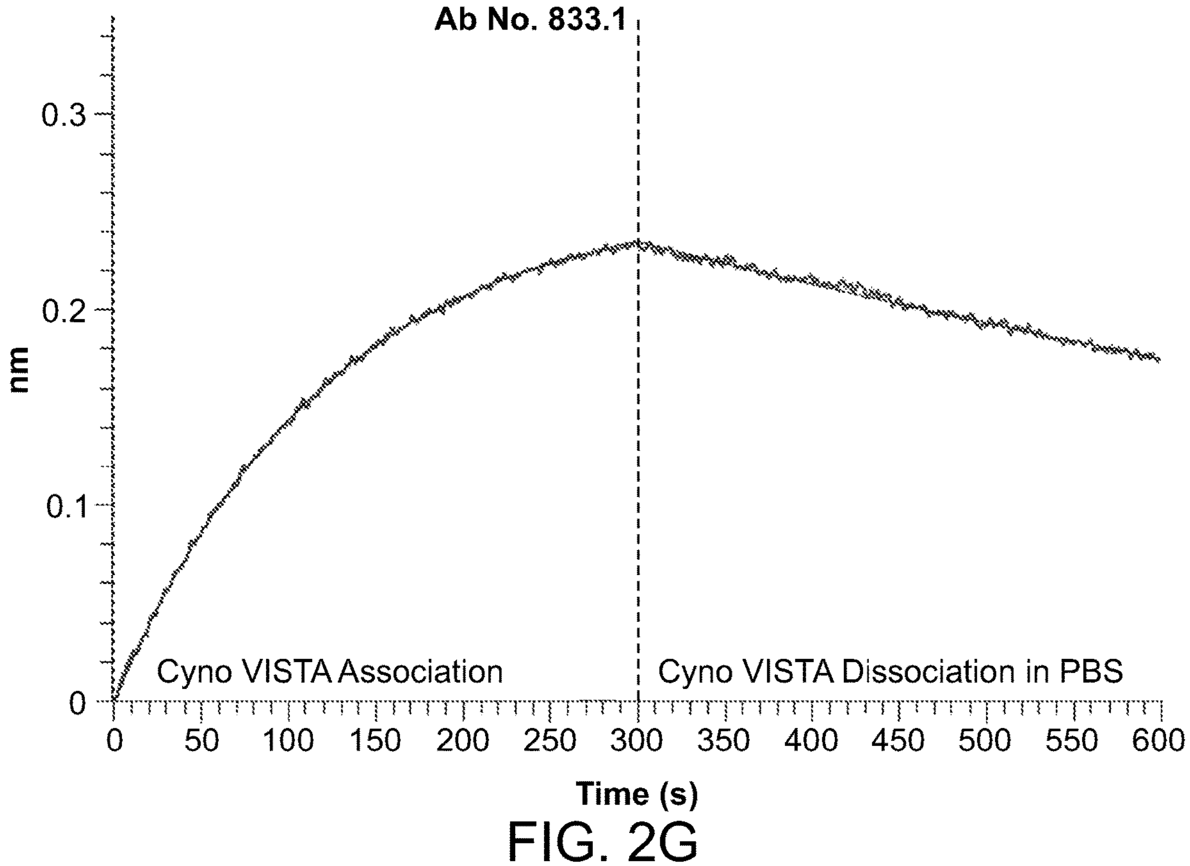
Figure 3A:
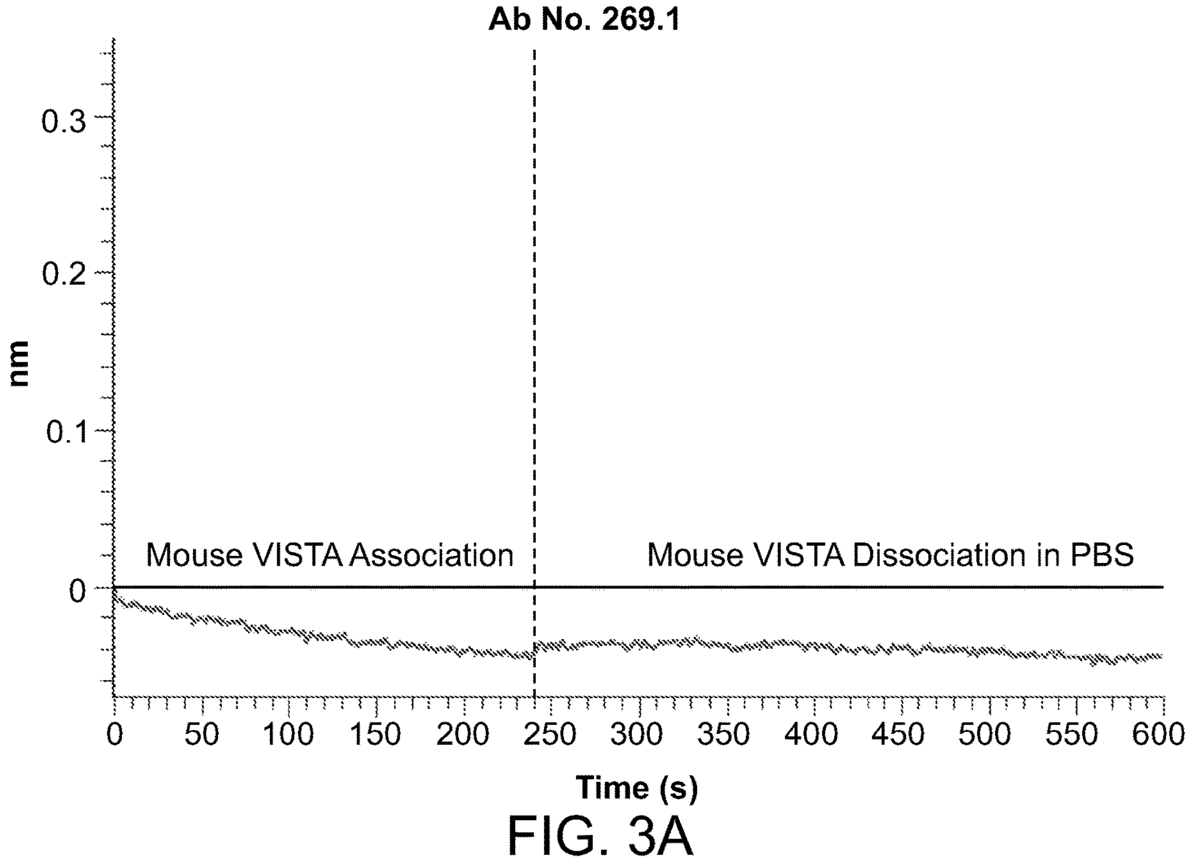
FIGS. 3A-3G. Octet sensorgrams measuring affinity of anti-VISTA antibodies No. 269.1 (FIG. 3A), No. 321.1 (FIG. 3B), No. 245.1 (FIG. 3C), No. 465.1 (FIG. 3D), No. 457.1 (FIG. 3E), No. 173.1 (FIG. 3F) and No. 833.1 (FIG. 3G) to mouse VISTA. Antibody affinities were measured using biolayer interferometry on the Octet Red 96 (ForteBio) system. Sensorgrams showing antigen (his-tagged mouse VISTA Met 1 to Ala 194) association and dissociation on biosensor (anti-human IgG Fc capture dip and read sensors) immobilized anti-VISTA antibodies.
Figure 3B:
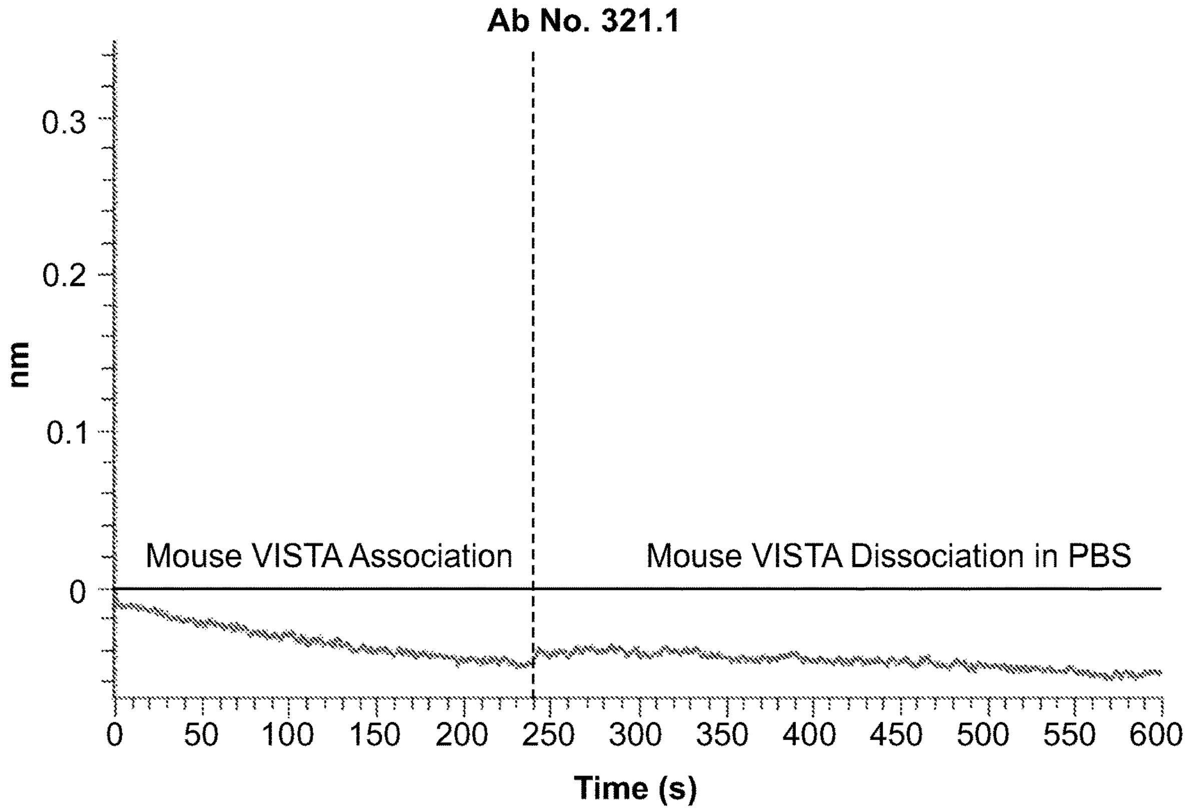
Figure 3C:
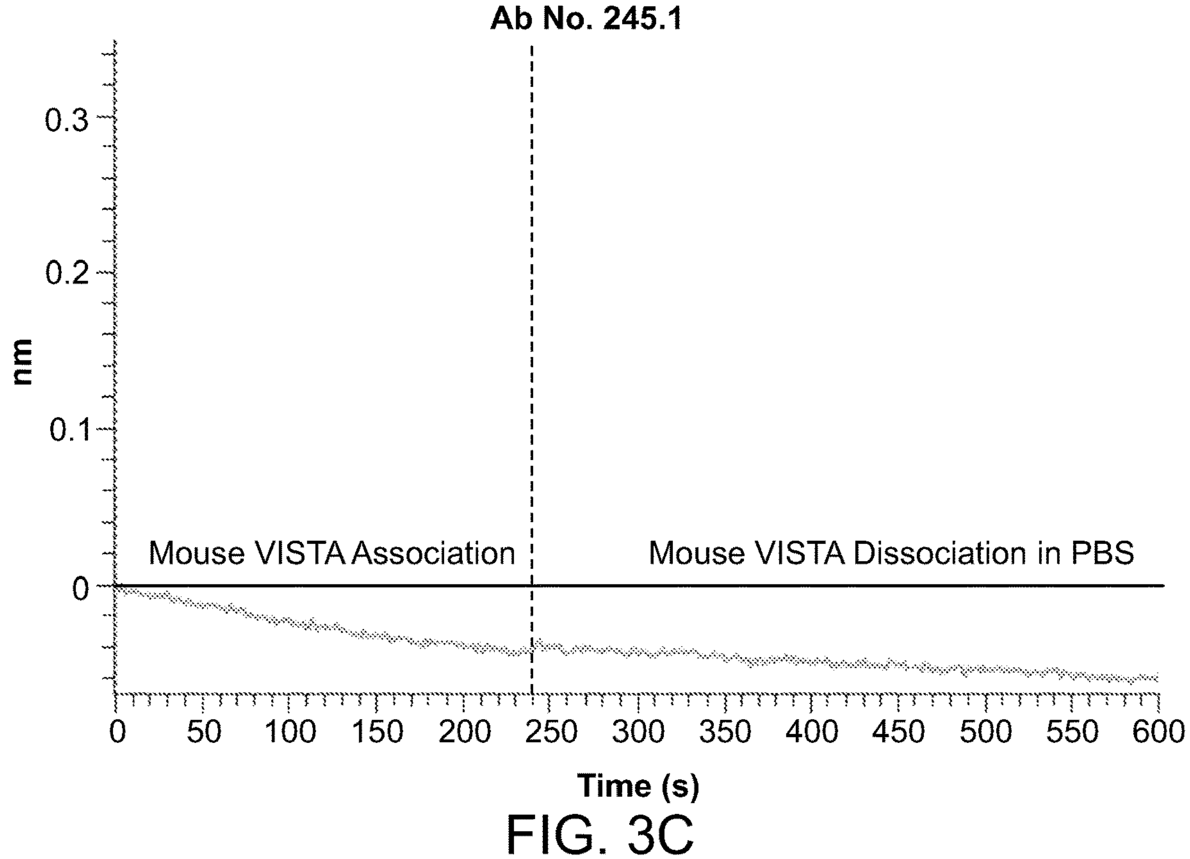
Figure 3D:
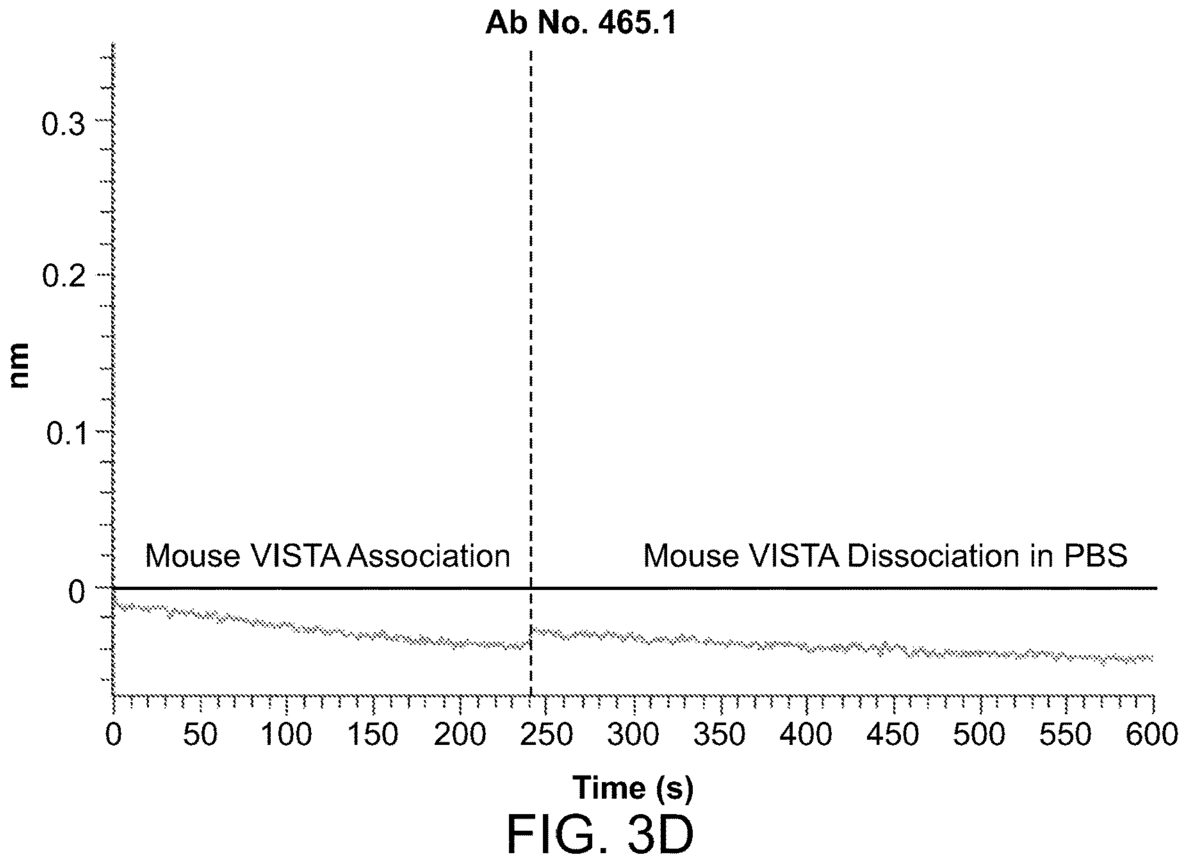
Figure 3E:
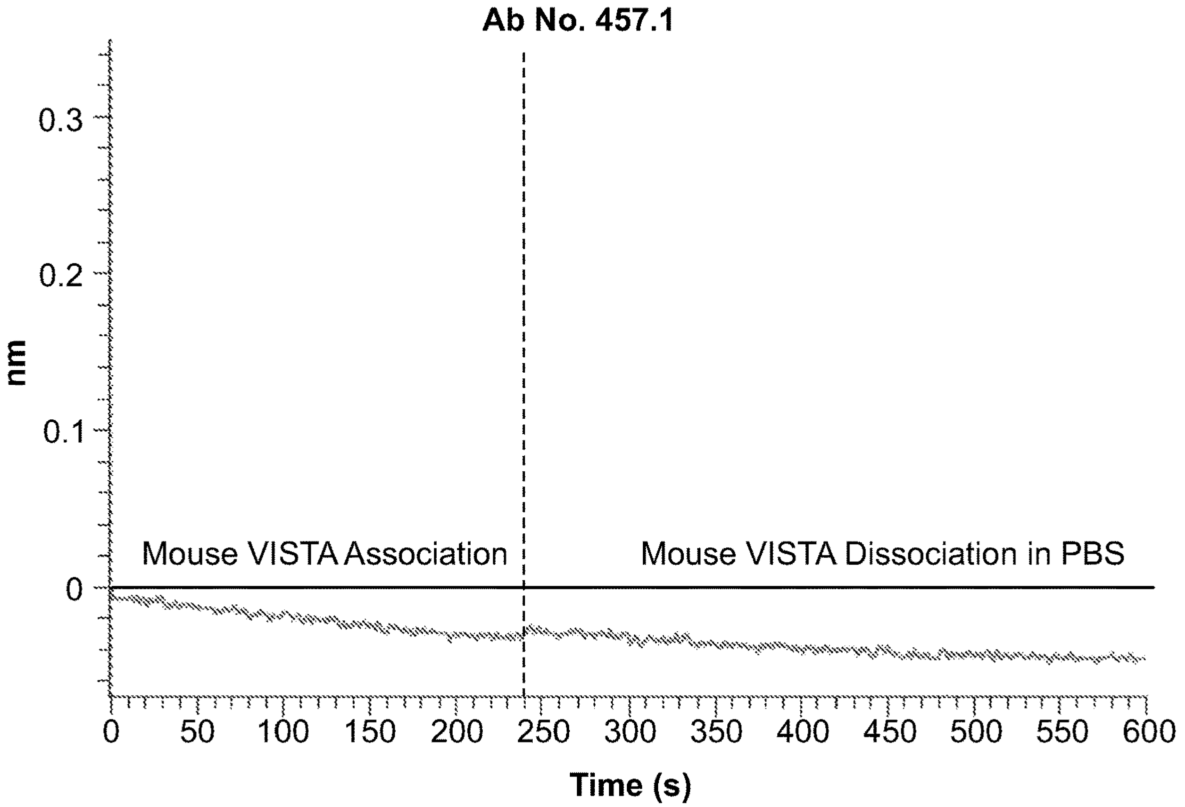
Figure 3F:
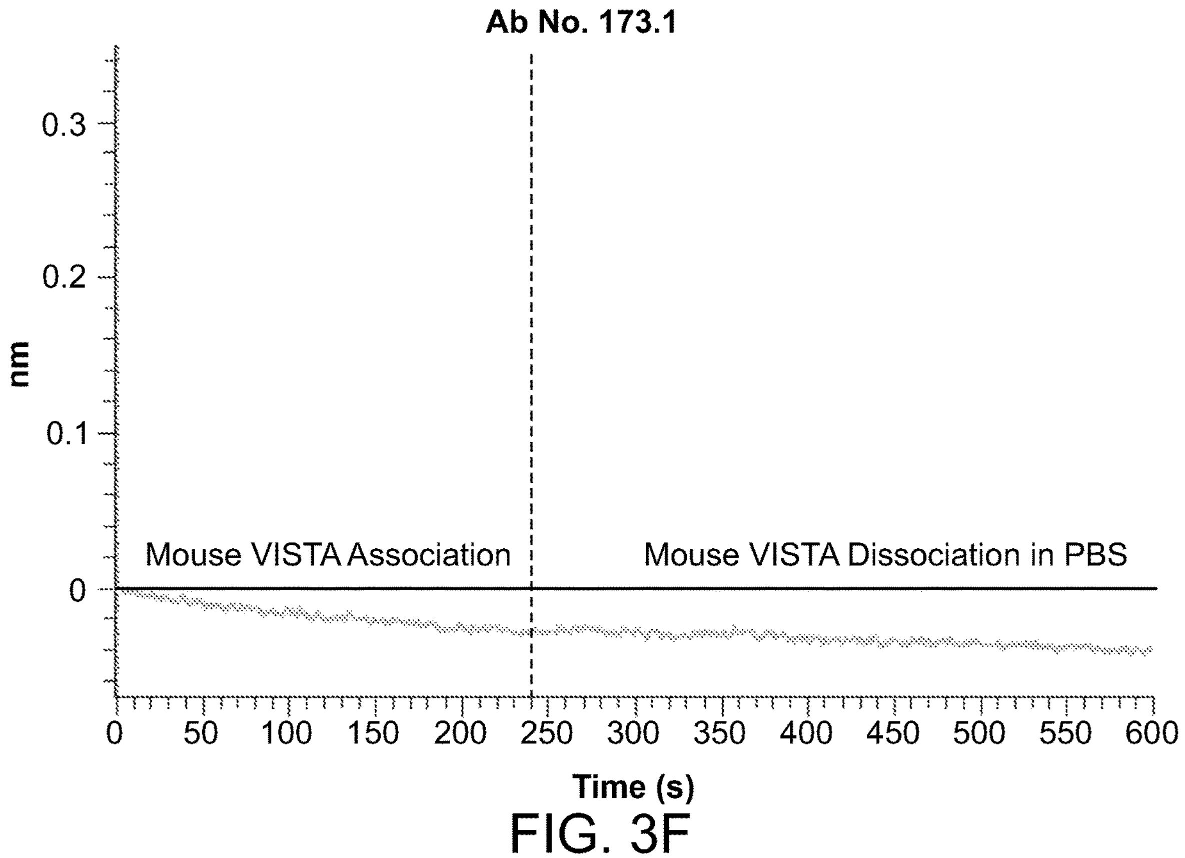
Figure 3G:
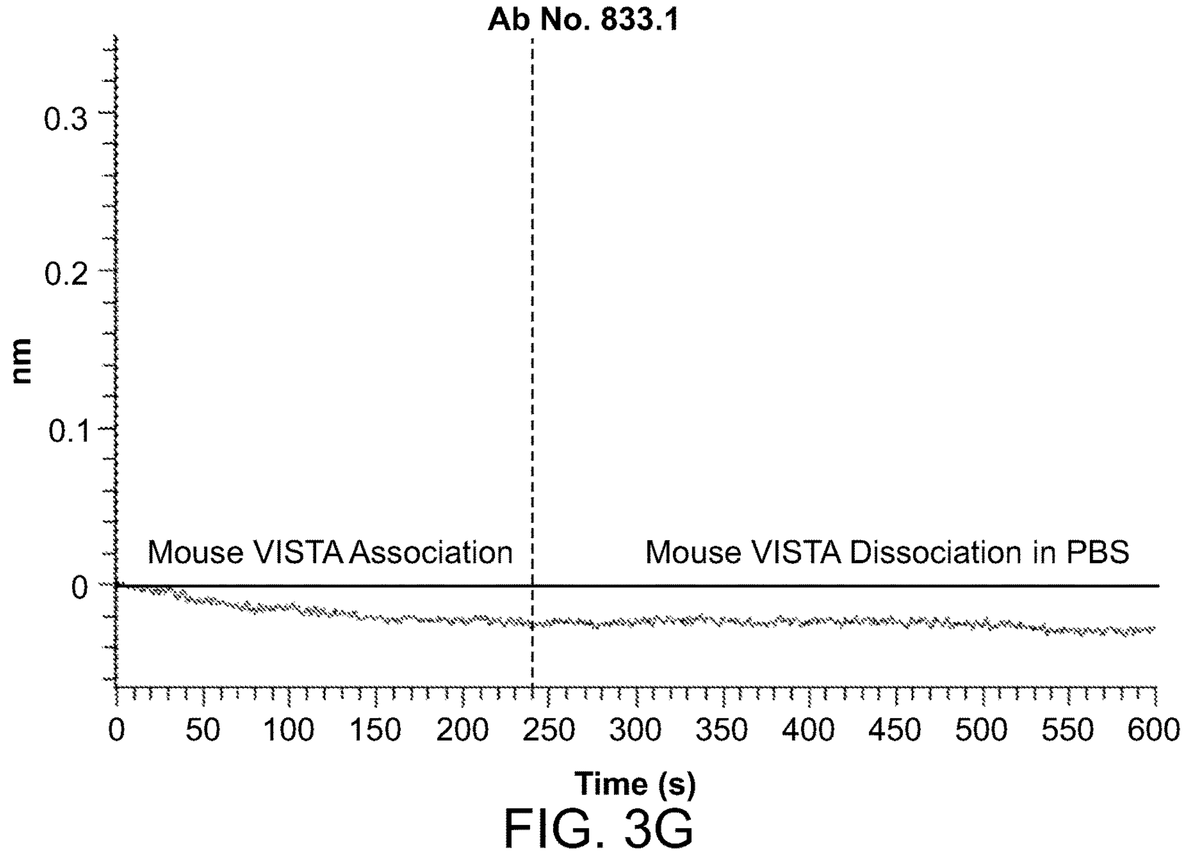
Figure 4A:
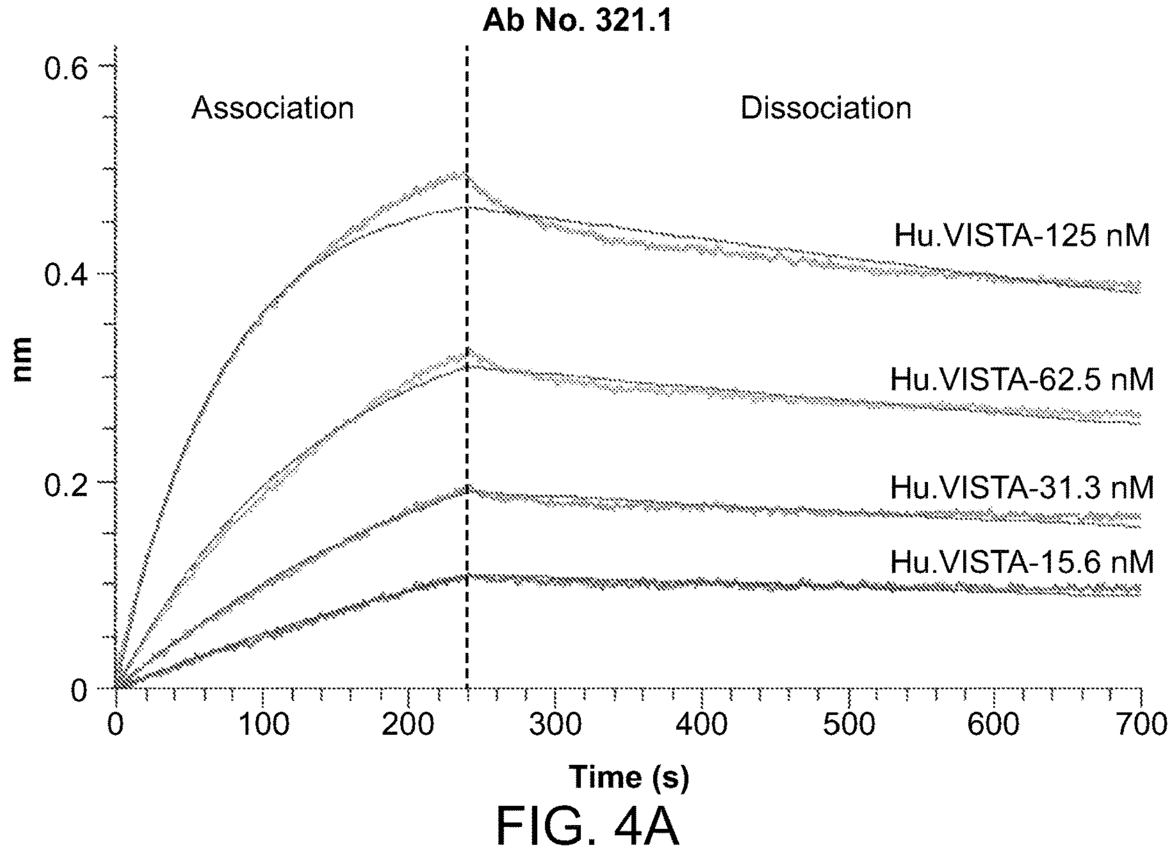
FIGS. 4A-4G. Full kinetic characterization of anti-VISTA antibodies No. 321.1 (FIG. 4A), No. 245.1 (FIG. 4B), No. 465.1 (FIG. 4C), No. 457.1 (FIG. 4D), No. 173.1 (FIG. 4E), No. 150.1 (FIG. 4F), and No. 474.1 (FIG. 4G) binding to human VISTA. Antibody affinities were measured using biolayer interferometry on the Octet Red 96 (ForteBio) system over a range of antigen concentrations. Sensorgrams showing antigen (his-tag human VISTA Met 1—Ala 194) association and dissociation on biosensor (anti-human IgG Fc capture dip and read sensors) immobilized anti-VISTA antibodies. Antigen concentrations that resulted in responses from 0.1-0.5 nm were used in analyses.
Figure 4B:
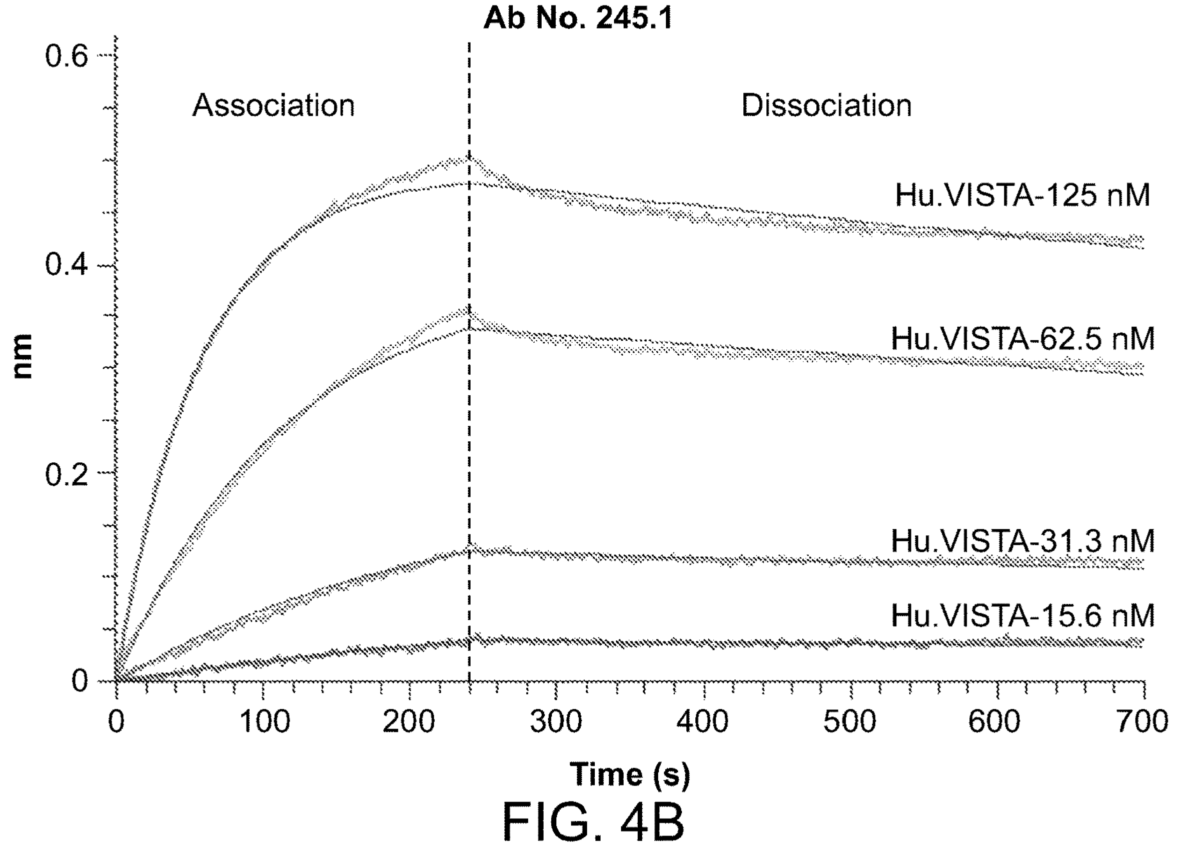
Figure 4C:
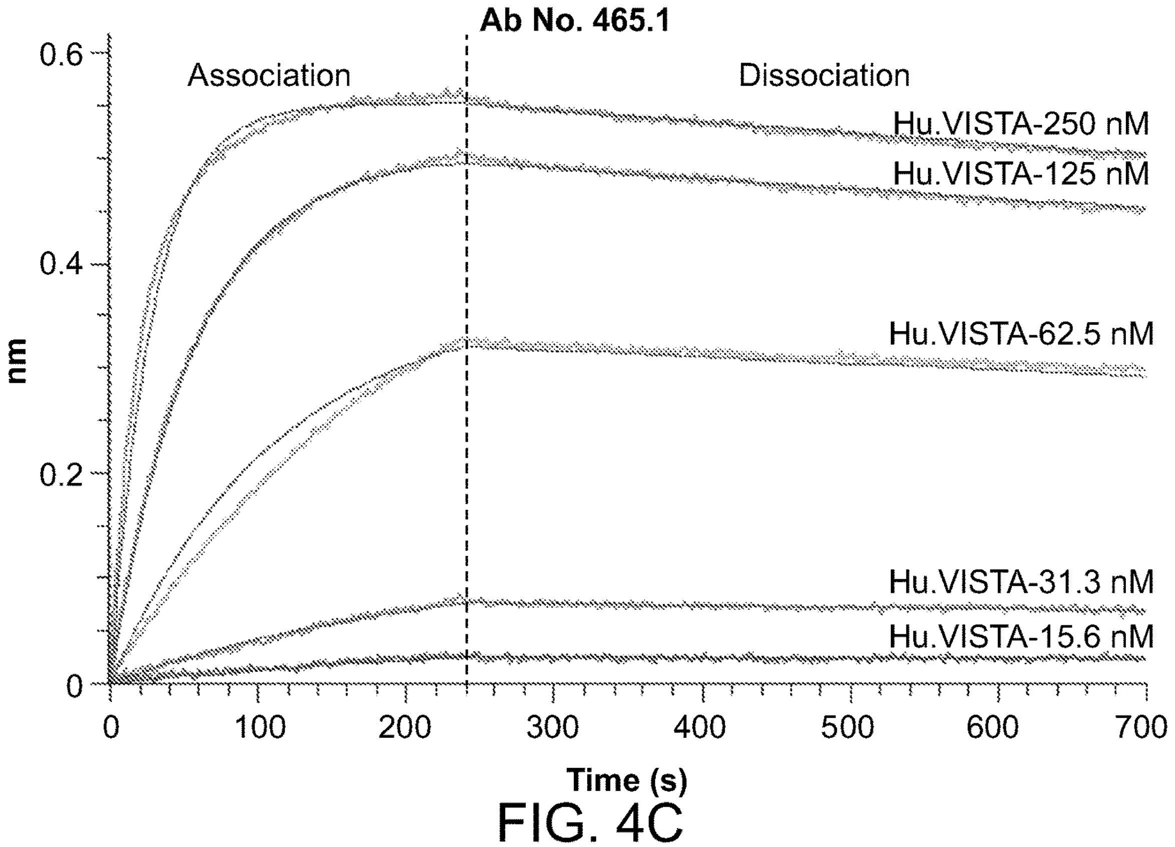
Figure 4D:
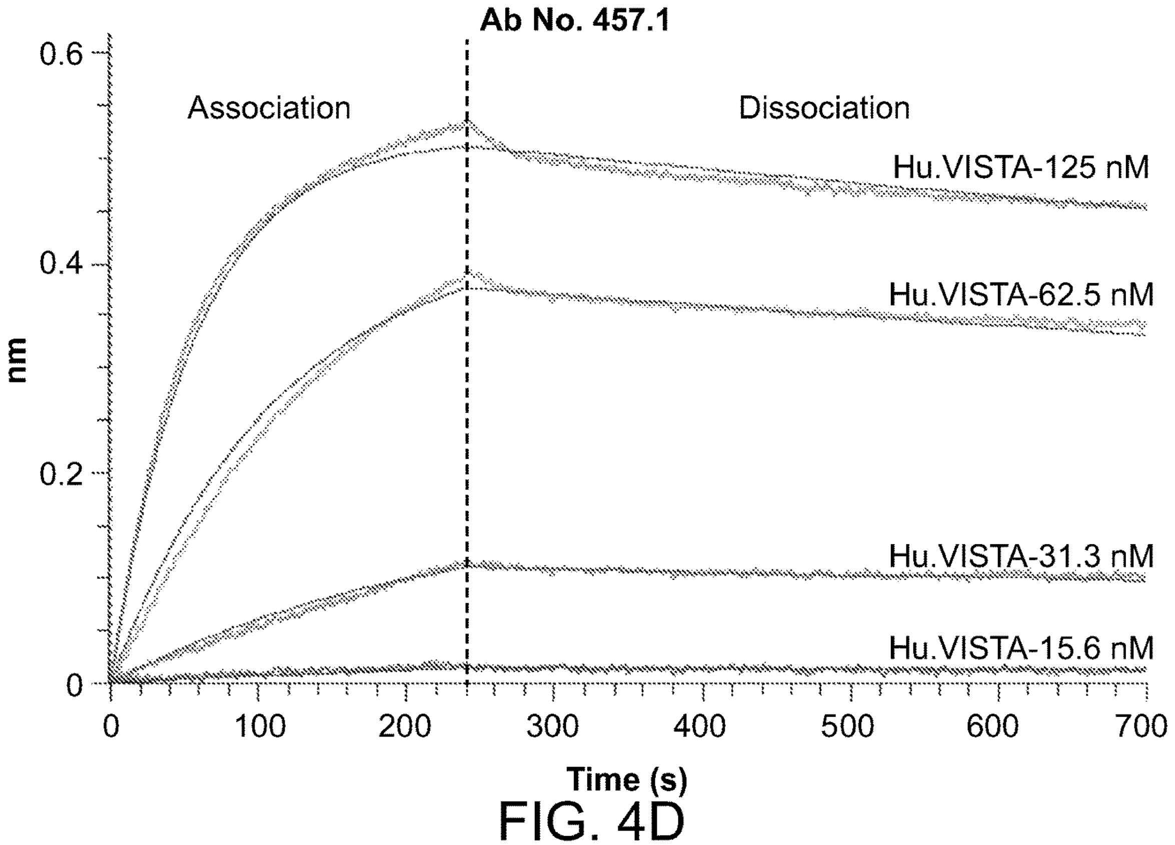
Figure 4E:
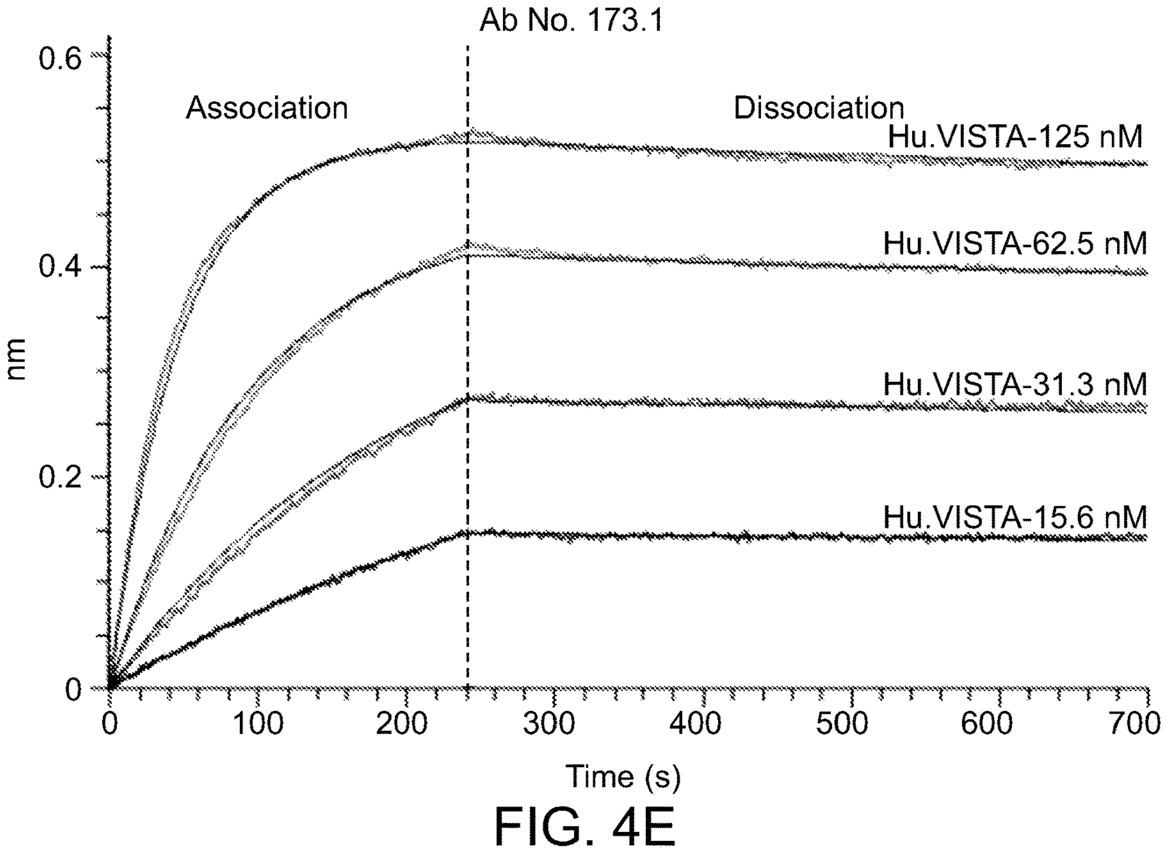
Figure 4F:
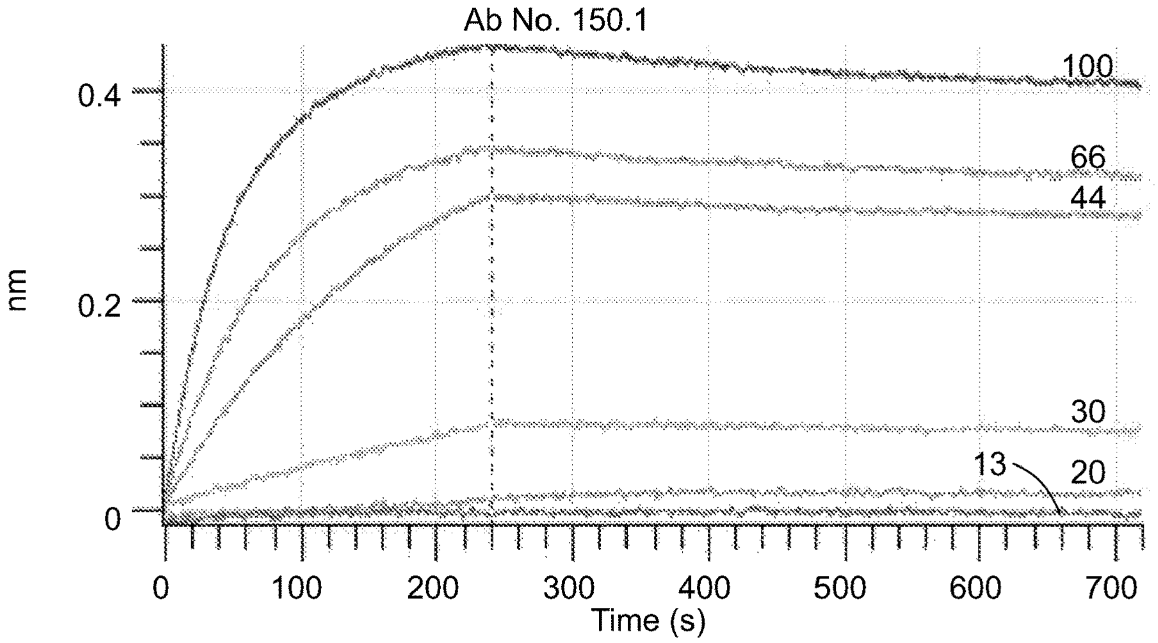
Figure 4G:
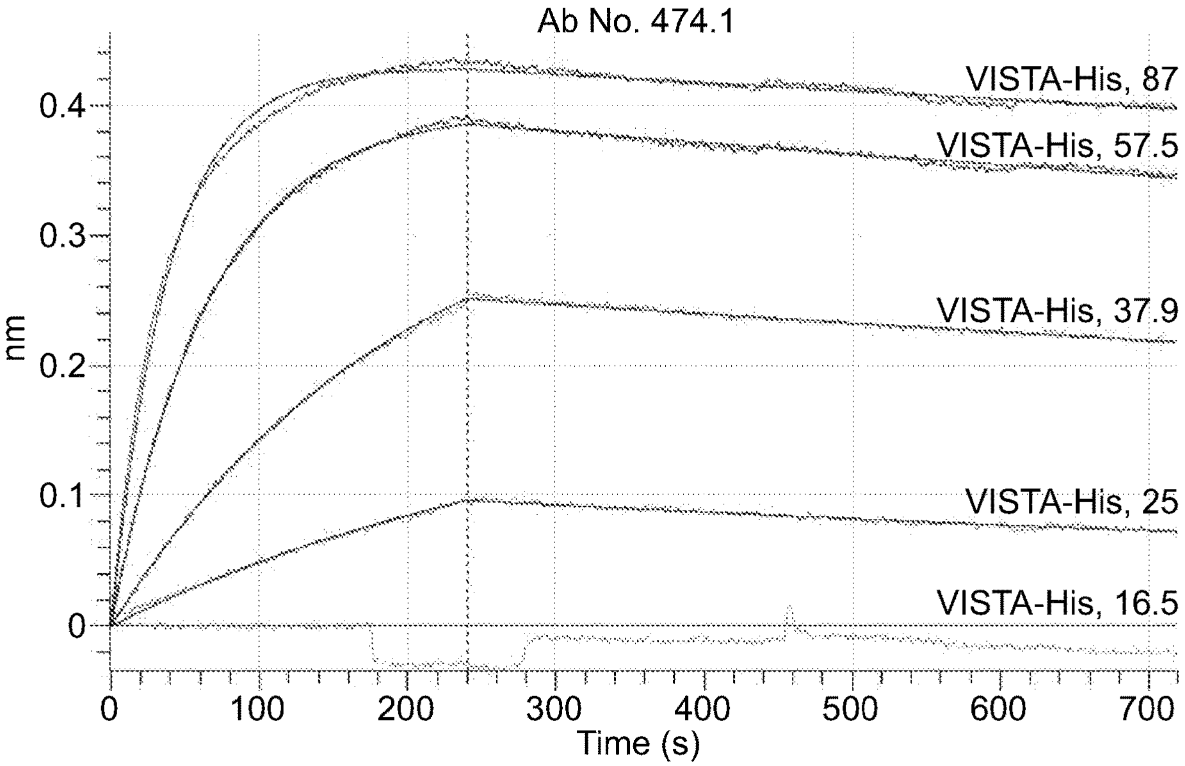
Figure 5A:
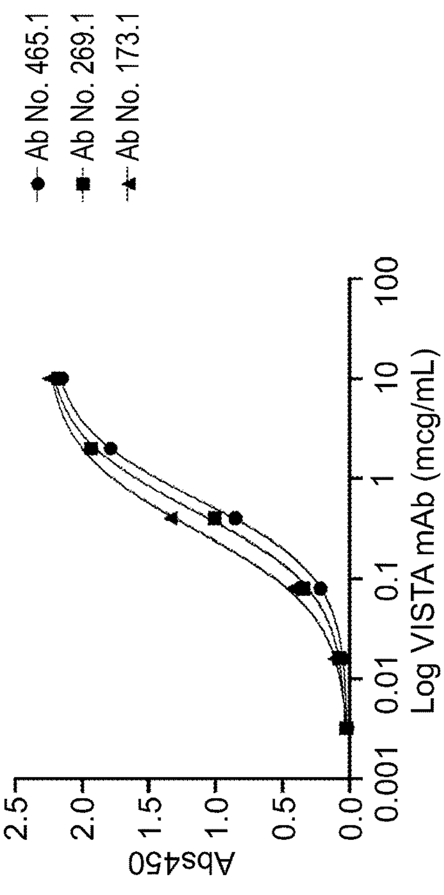
FIGS. 5A-5F. Dose response ELISA analysis of anti-VISTA antibodies bound to human VISTA. An ELISA assay was used to measure binding between immobilized antigen (his-tag VISTA extracellular domain) on a microtiter plate and anti-VISTA antibodies over a range of concentrations from 0.003-10 μg/mL. Antigen-antibody complexes were measured using a chromogenic assay, and data are plotted as absorbance at 450 nm versus log transformed antibody concentration. Curves were fit by nonlinear regression and EC50 values were calculated. Each graph represents the dose response data for 1-3 antibodies (antibodies tested are shown on the x-axis).
Figure 5B:
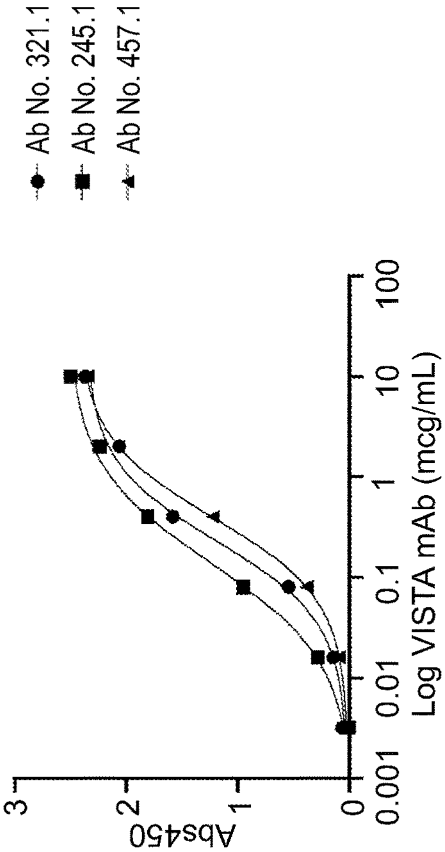
Figure 5C:
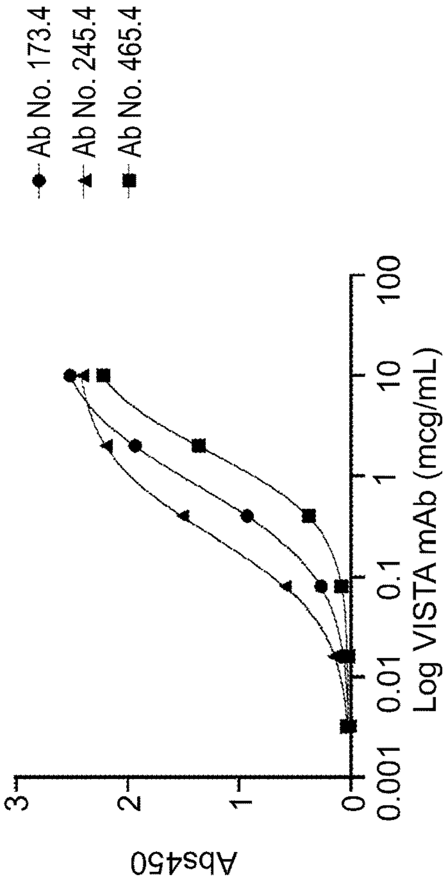
Figure 5D:
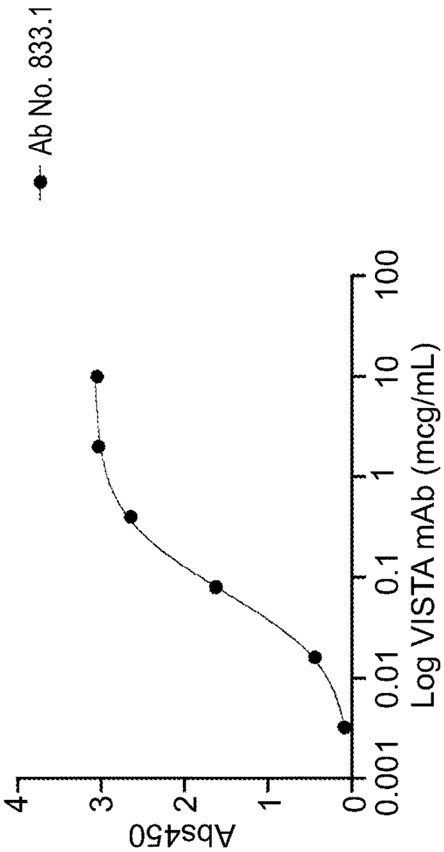
Figure 5E:
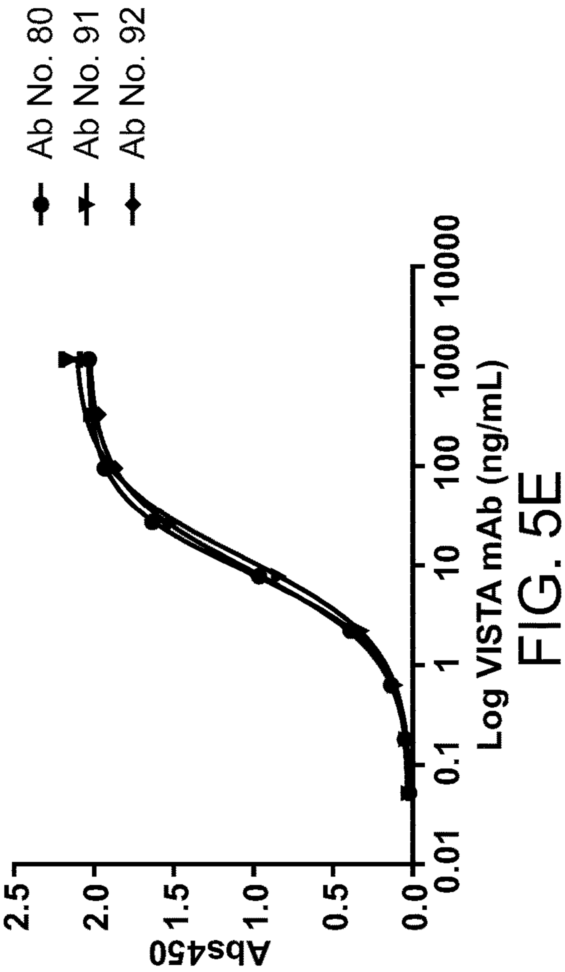
Figure 5F:
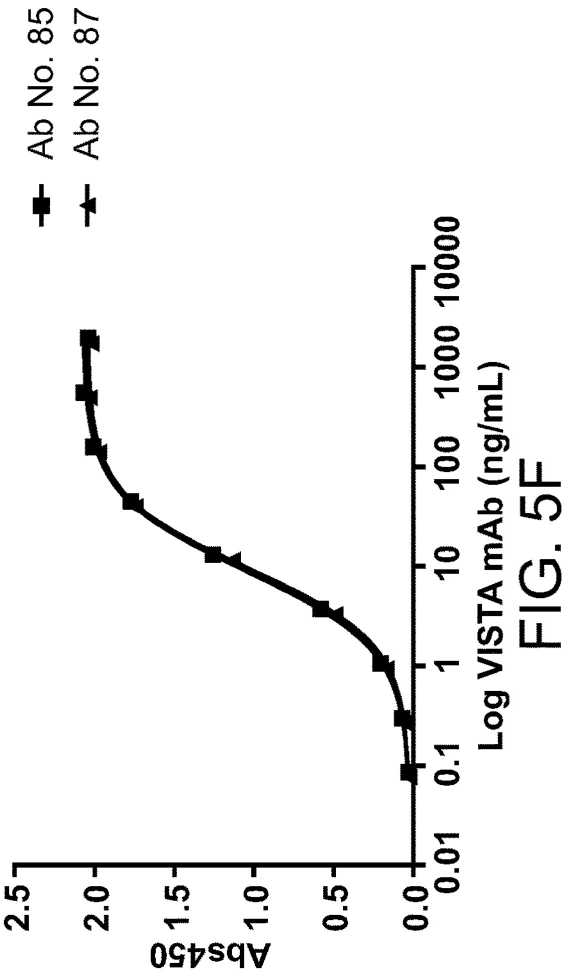

For human VISTA binding data, $EC_{50}$ values were calculated from nonlinear regression of log-transformed dose-response data. FIGS. 5E, 5F show dose response ELISA data for each anti-VISTA antibody on human VISTA, and Table 20 provides associated $EC_{50}$ values. All the antibodies demonstrate potent binding to human VISTA by ELISA with low nanomolar $EC_{50}$.

TABLE 20

$EC_{50}$ values for anti-VISTA antibodies on human VISTA as measured by ELISA.

| Antibody No | $EC_{50}$ (ng/mL) | $EC_{50}$ (nM) |
|---|---|---|
| 80 | 8.255 | 0.055 |
| 85 | 8.871 | 0.059 |
| 87 | 9.490 | 0.063 |
| 91 | 11.700 | 0.078 |
| 92 | 8.944 | 0.060 |

Example 7: Determination of Antibody Affinity by ELISA at pH 6.0, pH 6.5, pH 7.0, or pH 7.4

Figure 5G:
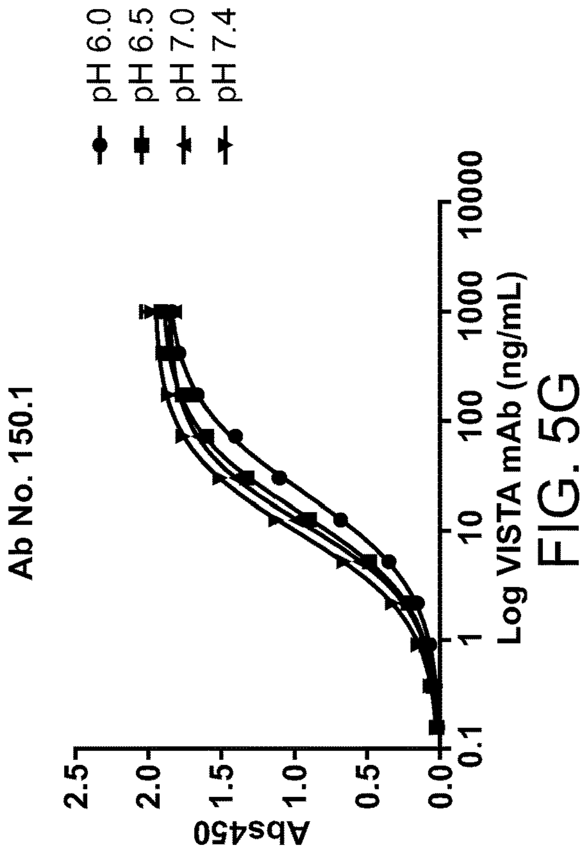
FIGS. 5G-5I. Dose response ELISA analysis of anti-VISTA antibodies bound to human VISTA at multiple pHs. An ELISA assay was used to measure binding between microtiter plate immobilized antigen (his-tag VISTA extracellular domain) and anti-VISTA antibodies over a range of concentrations from 0.16-1000 ng/mL at pH 6.0, pH 6.5, pH 7.0, and pH 7.4. Antigen-antibody complexes were measured using a chromogenic assay, and data are plotted as absorbance at 450 nm versus log transformed antibody concentration. Curves were fit by nonlinear regression and EC50 values were calculated. Each graph represents the dose response data for a single antibody at each tested pH. Maxisorb ELISA plates were used for this assay.
Figure 5H:
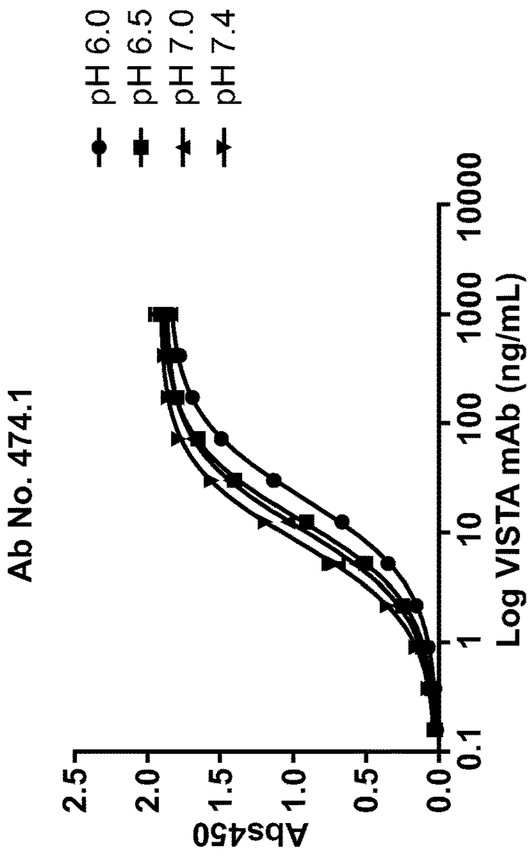
Figure 5I:
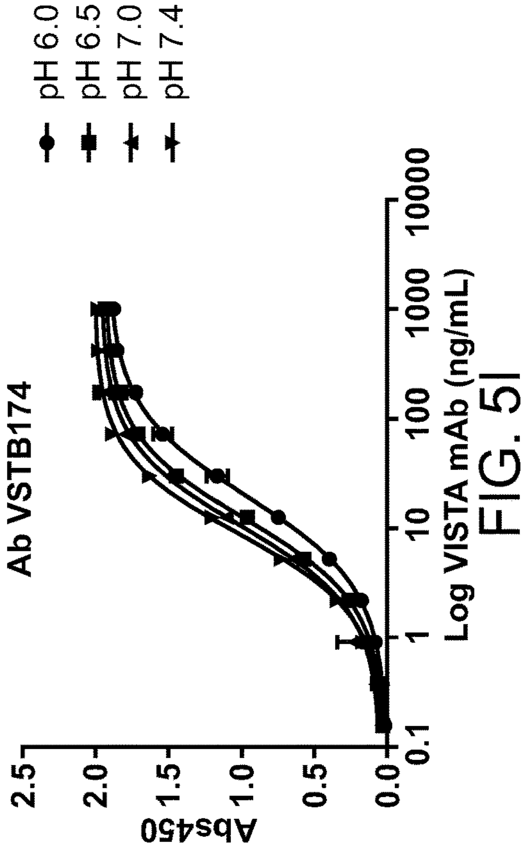
Figure 6A:
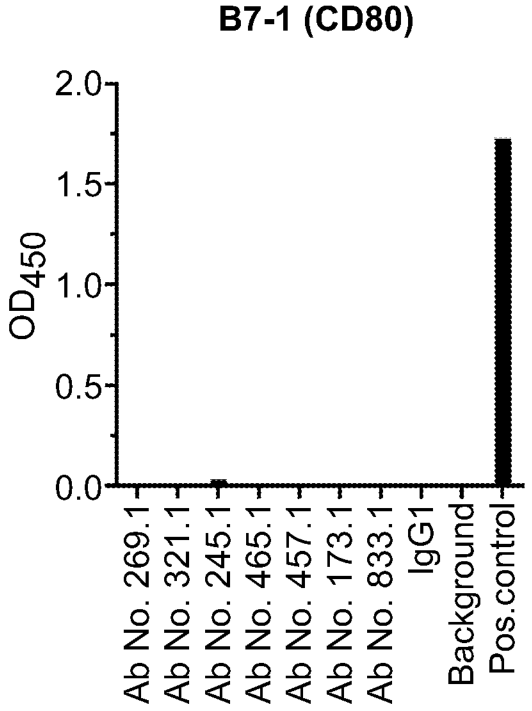
FIGS. 6A-6H. Anti-VISTA antibodies are specific to VISTA. Anti-VISTA antibodies were screened for binding to other B7 family members. All of the antibodies were specific to VISTA with no binding to other related human proteins. Antibodies tested are shown on the x-axis.
Figure 6B:
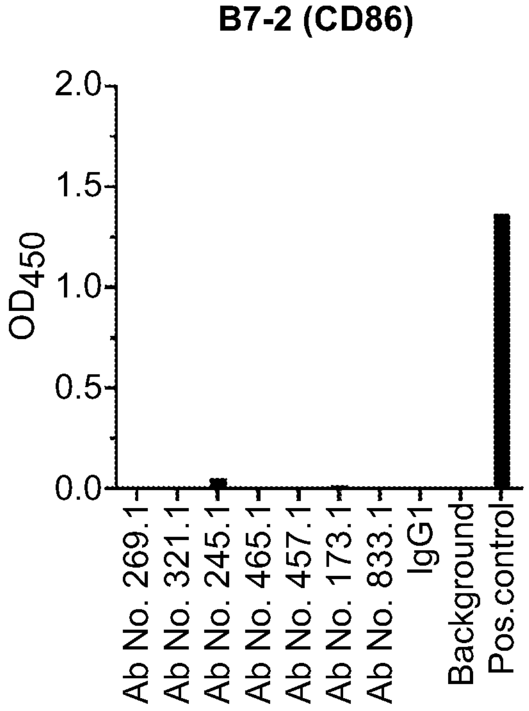
Figure 6C:
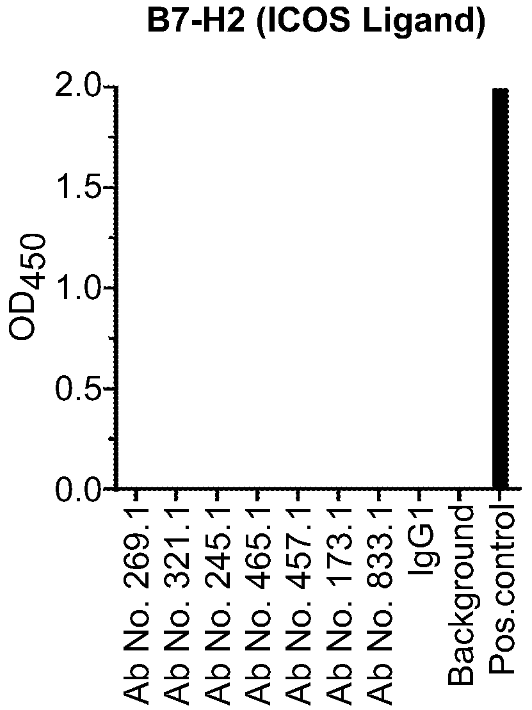
Figure 6D:
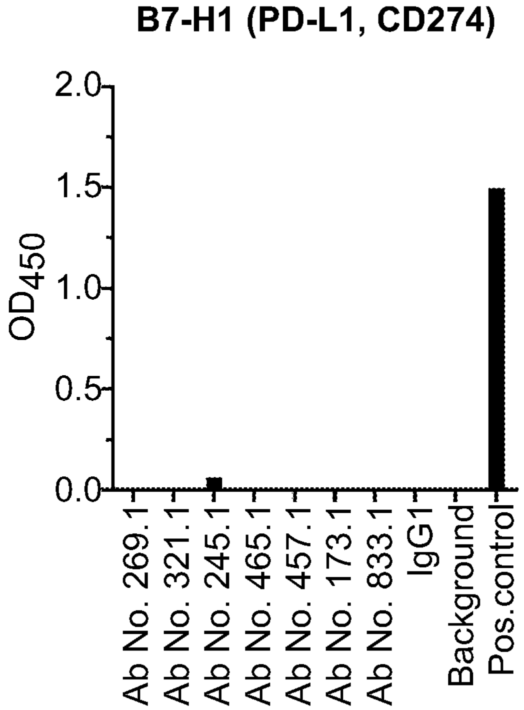
Figure 6E:
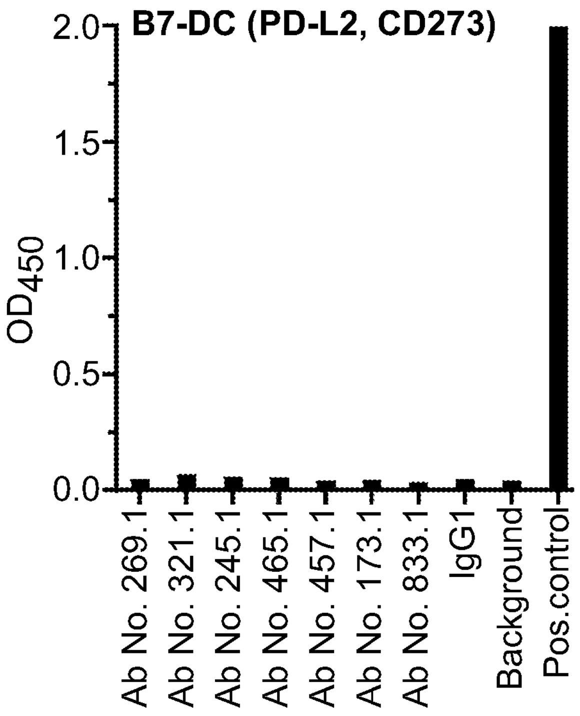
Figure 6F:
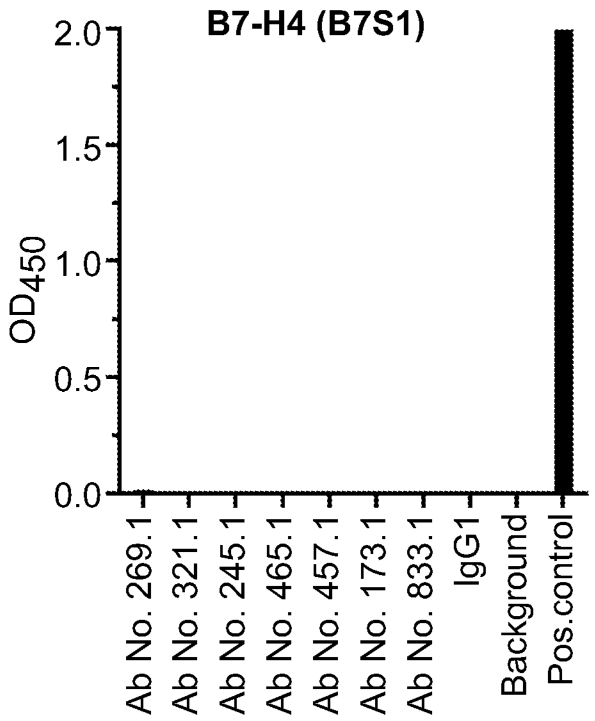
Figure 6G:
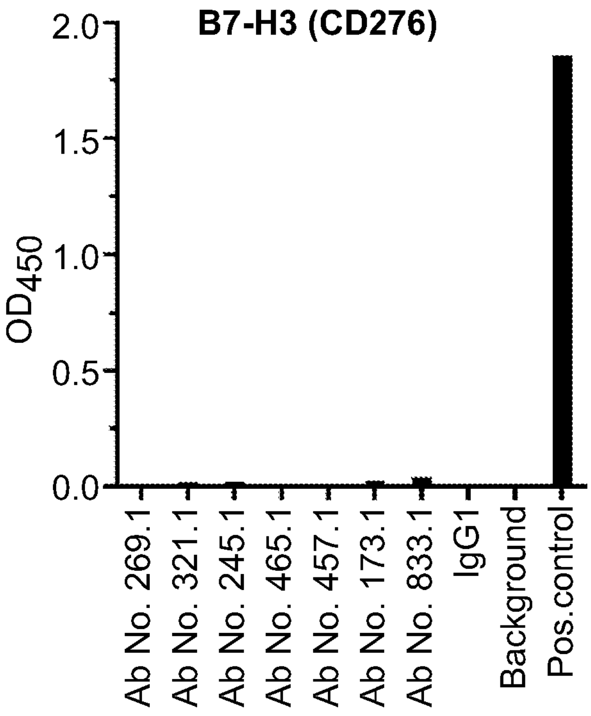
Figure 6H:
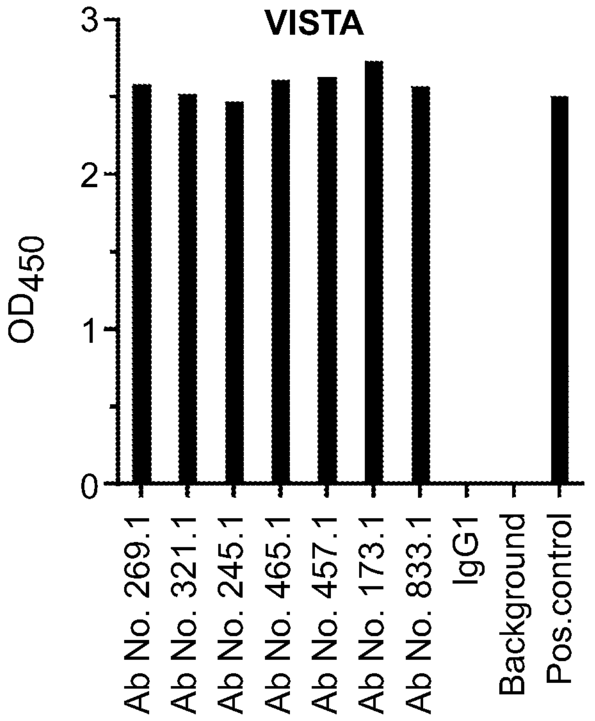

Maxisorb 96-well polystyrene ELISA plates were coated overnight at 4 deg C. with 100 μL of a 0.5 μg/mL solution of His-tag VISTA protein (SinoBiological, Met1-Ala194 produced in HE293 cells) in 0.1M $NaHCO_3$ pH 9.6. All subsequent incubations were performed at room temperature. Wells were washed 3 times with PBST (0.05% Tween 20) and blocked for 2 h with 200 μL 5% BSA in PBST. Anti-VISTA antibodies were diluted in 0.5% BSA in PBST to 1000 ng/mL, and 2.4-fold serial dilutions were made from 1000 ng/mL-0.16 ng/mL in 0.5% BSA/PBST at pH 6.0, pH 6.5, pH 7.0, or pH 7.4. Each antibody dilution was incubated (100 μL/well) in the ELISA plate for 1 h, after which plates were washed 3 times with PBST at pH 6.0, pH 6.5, pH 7.0, or pH 7.4 and incubated with a 1:20,000 dilution of Biotin SP AffiniPure Donkey Anti-Human IgG (H+L) polyclonal antibody (Jackson ImmunoResearch, 100 μL/well) at pH 6.0, pH 6.5, pH 7.0, or pH 7.4 for 1 h. Wells were washed 3 times with PBST at pH 6.0, pH 6.5, pH 7.0, or pH 7.4, and the plates were incubated with 100 μL of a 1:200 dilution of Streptavidin-HRP (R&D Systems) at pH 6.0, pH 6.5, pH 7.0, or pH 7.4 for 30 min. Wells were washed 3 times with PBST at pH 6.0, pH 6.5, pH 7.0, or pH 7.4 and developed with 100 μL 1-Step Ultra Fast TMB Substrate (Thermo Scientific) for 1.5 minutes. The reaction was stopped with 100 μL 2N H2SO4, and plate well absorbance was measured at 450 nm (CLARIOstar microplate reader), FIGS. 5G-5I show dose response ELISA data for each anti-VISTA antibody on human VISTA at different pH, and Table 21 provides associated $EC_{50}$ values. All the antibodies demonstrate potent binding to human VISTA by ELISA with low nanomolar $EC_{50}$ at all pHs with a reduced binding observed at pH6.0. Reduced binding at acidic pH is more pronounced for Ab No. 150.1.

TABLE 21

$EC_{50}$ values for anti-VISTA antibodies on human VISTA at different pHs as measured by ELISA.

| Antibody | $EC_{50}$ (ng/mL) | | | | $EC_{50}$ (nM) | | | |
|---|---|---|---|---|---|---|---|---|
| No | pH 6.0 | pH 6.5 | PH 7.0 | pH 7.4 | pH 6.0 | pH 6.5 | pH 7.0 | pH 7.4 |
| 150.1 | 22.31 | 14.37 | 11.54 | 9.76 | 0.15 | 0.99 | 0.08 | 0.07 |
| 474.1 | 20.69 | 13.19 | 10.91 | 8.23 | 0.14 | 0.91 | 0.08 | 0.06 |
| VSTB174 | 19.34 | 12.16 | 10.51 | 8.84 | 0.13 | 0.84 | 0.07 | 0.06 |

Example 8: Anti-VISTA Antibody Binding Specificity

Anti-VISTA antibodies were evaluated for their ability to bind to related members of the B7 protein family using ELISA. The following his-tagged B7 proteins were evaluated for off-target binding: CD80/B7-1, CD86/B7-2, ICOS/B7-H2, PD-L1/B7-H1, B7-DC/PD-L2/CD273, B7-H4/B7S1/B7x, and B7-H3/CD276 (all from Sino Biological). Maxisorb 96-well ELISA plates (Thermo Fisher Scientific) were coated with each B7 family member protein at 50 μL/well of a 2 μg/mL solution in 0.1M $NaHCO_3$ pH 9.6. overnight at 4° C. or for 1 h at 37° C. Plates were washed with PBST and blocked with 200 μL 5% BSA in PBST for 2 h at room temperature. Following further washes, the primary antibody was bound to each plate for 1 h at room temperature. Anti-VISTA antibodies were bound at 10 μg/mL. The following control antibodies were used at a 1:2000 or 1:10000 dilution: anti-CD80/B7-1 Antibody, Mouse mAb (SinoBiologics, Cat #10698-MM01), anti-CD86/B7-2 Antibody, Mouse mAb (SinoBiologics, Cat #10699-MM02), anti-ICOS/B7-H2 Antibody, Mouse mAb (SinoBiologics, Cat #11559-MM07), anti-PD-L1/B7-H1 Antibody, Mouse mAb (SinoBiologics, Cat #10084-MM37), anti-B7-DC/PD-L2/CD273 Antibody, Rabbit mAb (SinoBiologics Cat #10292-R018), anti-B7-H4/B7S1/B7× Antibody, Rabbit pAb (SinoBiologics, Cat #10738-T24), anti-B7-H3/CD276 Antibody, Mouse mAb (SinoBiologics, Cat #11188-M008) and Ultra-LEAF™ Purified Human IgG1 Isotype Control (BioLegend). Primary antibodies were decanted, and plates were washed 3 times with PBST followed by incubation with 1:10000 dilution (50 μL) HRP-conjugated anti-mouse, anti-human or anti-rabbit IgG for 1 h at room temperature. Following further washes, plates were developed with 100 μL 1-Step Ultra TMB Substrate at room temperature for 2 min. None of the anti-VISTA antibodies bound members of the B7 protein family other than VISTA (FIGS. 6A-6H).

Example 9: Antibody Binding to Cell Surface VISTA

Cross-species binding: Antibodies were evaluated for their ability to bind human, mouse and cynomolgus monkey VISTA stably expressed on CHO K1 cells. VISTA-expressing CHO cell lines were grown to confluence in F-12K media (ATCC) with 10% fetal bovine serum (FBS) under selection. Cells were detached from tissue culture flasks with Accutase (Thermo Fisher Scientific) at room temperature, diluted in F12-K media with 10% FBS, and washed with cold PBS. Cells in suspension were diluted to a final concentration of $1.5\times10^6$ cells/mL and 100 μL were dispensed per well of a microtiter plate. Cells were pelleted by centrifugation and resuspended in 50 μL of a 1:1000 dilution of fixable live/dead nIR stain (Thermo Fisher) for 30 min on ice. Cells were diluted in FACS staining buffer (4% FBS, 0.05% sodium azide in PBS), recovered by centrifugation and incubated in 50 L of anti-VISTA antibody, diluted in FACS staining buffer to 0.05, 1 or 150 nM, on ice for 30 min. Cells were washed with progressive dilutions of FACS staining buffer in PBS and resuspended in 50 μL secondary antibody diluted 1:200 in FACS staining buffer (PE-labeled Goat Anti-Human IgG (H+L), Jackson ImmunoResearch) followed by incubation on ice for 30 min. Cells were washed as before, resuspended in 50 μL cold PBS and treated with addition of 150 μL Cytofix (BD Pharmingen) for 5 min at room temperature. Cells were collected by centrifugation and resuspended in PBS. Sample data was collected on an Attune NXT flow cytometer.

Figure 7A:
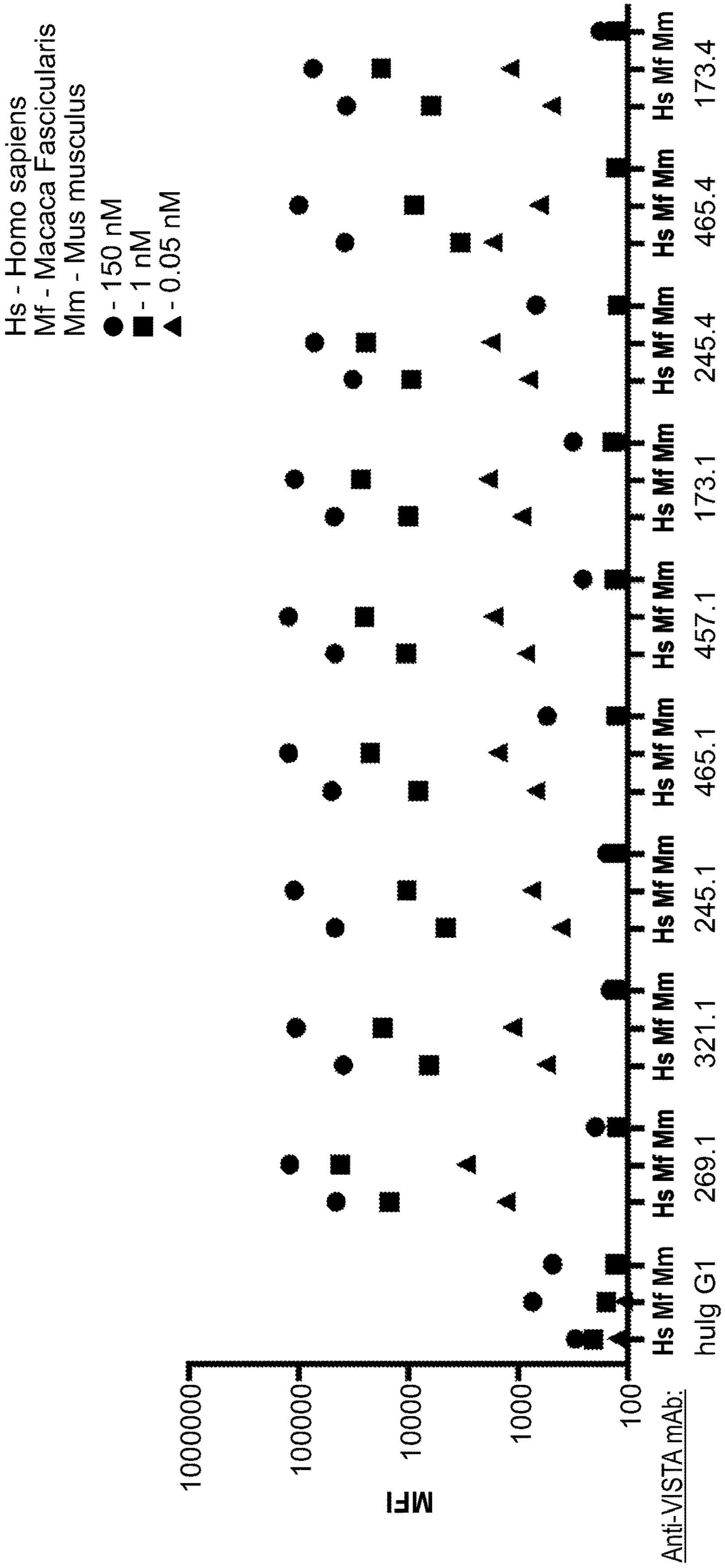
FIGS. 7A, 7B, 7C. Anti-VISTA antibody binding to VISTA stably expressed on CHO K1 cells. Antibodies were evaluated for their ability to bind human, mouse and cynomolgus monkey VISTA stably expressed on CHO K1 cells. Cells were incubated with 0.05, 1 or 150 nM of each anti-VISTA antibody. Antibody bound to cells was detected with a PE-conjugated secondary antibody, and mean fluorescent intensity (MFI) of binding was measured by FACS analysis. Data are plotted as log-transformed MFI. Each antibody was evaluated against CHO cells expressing human ("Hs"), cynomolgus monkey ("Mf") and mouse ("Mm") VISTA. Circles, MFI at 150 nM; squares, MFI at 1 nM, triangles, MFI at 0.05 nM antibody concentration. Antibodies tested are shown on the x-axis.
Figure 7B:
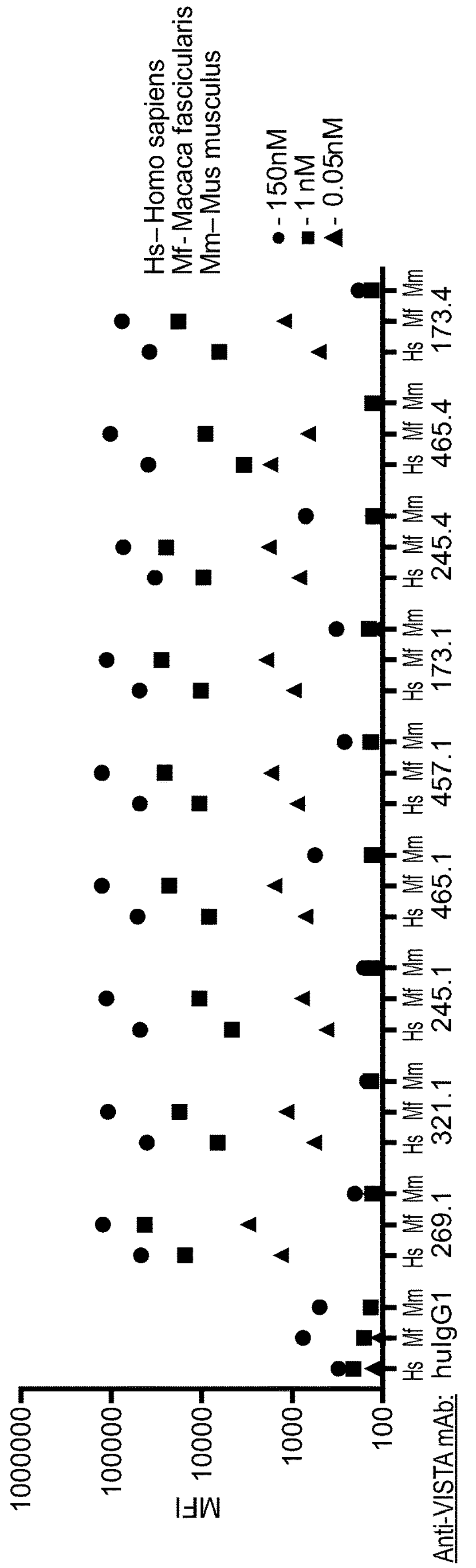
Figure 7C:
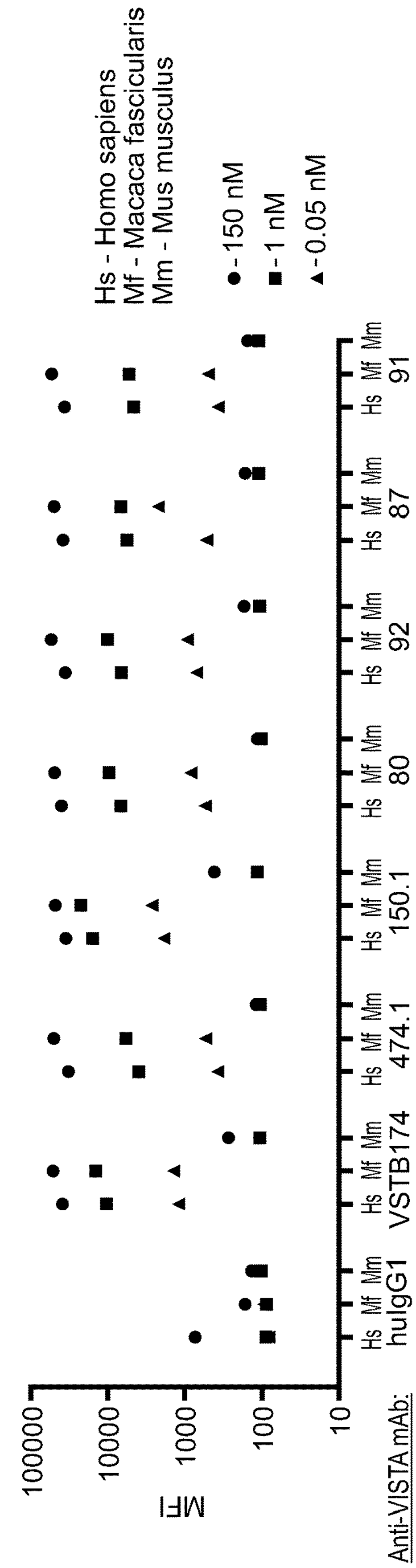

FIG. 7A-7C show the mean fluorescent intensity from anti-VISTA antibody binding to CHO cells stably expressing human, monkey and mouse VISTA at 150 nM, 1 nM and 0.05 nM. Antibodies demonstrated potent binding to monkey and human VISTA. MFI levels for these cell lines are roughly equivalent between species at all antibody concentrations. None of the antibodies demonstrate significant binding to mouse VISTA.

Figure 8A:
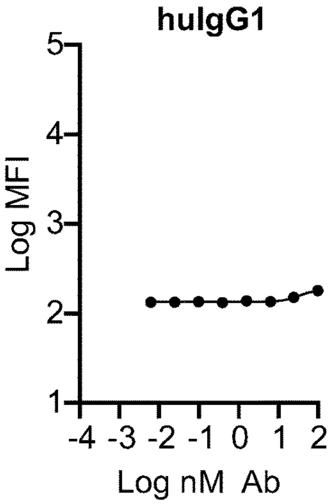
FIGS. 8A-8R. Multipoint dose response binding data to VISTA expressed on the cell surface. Human IgG1 (FIG. 8A) and IgG4 (FIG. 8O) controls and Anti-VISTA antibodies No. 269.1 (FIG. 8B), No. 321.1 (FIG. 8C), No. 245.1 (FIG. 8D), No. 465.1 (FIG. 8E), No. 457.1 (FIG. 8F), No. 173.1 (FIG. 8G), VSTB174 (FIG. 8H), No. 474.1 (FIG. 81), No. 150.1 (FIG. 8J), No. 80 (FIG. 8K), No. 92 (FIG. 8L), No. 87 (FIG. 8M), No. 91 (FIG. 8N), No. 245.4 (FIG. 8P), No. 465.4 (FIG. 8Q), and No. 173.4 (FIG. 8R) were evaluated for their ability to bind human, mouse and cynomolgus monkey VISTA stably expressed on CHO K1 cells at 0.006, 0.024, 0.098, 0.391, 1.563, 6.25, 25, and 100 nM, or at 0.003, 0.012, 0.049, 0.195, 0.781, 3.125, 12.5, and 50 nM. Data were plotted as log transformed MFI versus log transformed antibody concentration. Curves were fit by nonlinear regression with variable slope, and EC50 values were calculated.
Figure 8B:
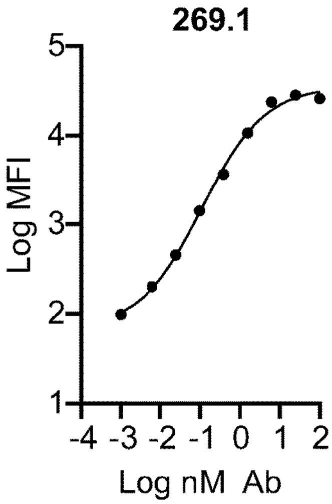
FIG. 8S. Evaluation of mutant VISTA-ECD-Fc binding to Antibody No. 474.1. Binding of Ab No. 474.1 was tested using human VISTA-ECD mutants. Ab No. 474.1 titrated at 100 ug/mL-0.003 ug/mL was captured on a 96-well plate coated with mutant VISTA-ECDs at 3 ug/mL. Ab No. 474.1 was detected using biotinylated anti-human Ig light chain kappa followed by streptavidin-HRP and TMB substrate. 450 nm optical density was determined using a CLARIOstar plate reader.
FIG. 8T. Evaluation of mutant VISTA-ECD-Fc binding to Antibody No. 150.1. Binding of Ab No. 150.1 was tested using human VISTA-ECD mutants. Ab No. 150.1 titrated at 100 ug/mL-0.003 ug/mL was captured on a 96-well plate coated with mutant VISTA-ECDs at 3 ug/mL. Ab No. 150.1 was detected using biotinylated anti-human Ig light chain kappa followed by streptavidin-HRP and TMB substrate. 450 nm optical density was determined using a CLARIOstar plate reader.
FIG. 8U. Evaluation of mutant VISTA-ECD-Fc binding to Antibody No. 85. Binding of Ab No. 85 was tested using human VISTA-ECD mutants. Ab No. 85 titrated at 100 ug/mL-0.003 ug/mL was captured on a 96-well plate coated with mutant VISTA-ECDs at 3 ug/mL. Ab No. 85 was detected using biotinylated anti-human Ig light chain kappa followed by streptavidin-HRP and TMB substrate. 450 nm optical density was determined using a CLARIOstar plate reader.
FIG. 8V. Evaluation of mutant VISTA-ECD-Fc binding to Antibody No. 87. Binding of Ab No. 87 was tested using human VISTA-ECD mutants. Ab No. 87 titrated at 100 ug/mL-0.003 ug/mL was captured on a 96-well plate coated with mutant VISTA-ECDs at 3 ug/mL. Ab No. 87 was detected using biotinylated anti-human Ig light chain kappa followed by streptavidin-HRP and TMB substrate. 450 nm optical density was determined using a CLARIOstar plate reader.
FIG. 8W. Evaluation of mutant VISTA-ECD-Fc binding to Antibody No. 91. Binding of Ab No. 91 was tested using human VISTA-ECD mutants. Ab No. 91 titrated at 100 ug/mL-0.003 ug/mL was captured on a 96-well plate coated with mutant VISTA-ECDs at 3 ug/mL. Ab No. 91 was detected using biotinylated anti-human Ig light chain kappa followed by streptavidin-HRP and TMB substrate. 450 nm optical density was determined using a CLARIOstar plate reader.
FIG. 8X. Evaluation of mutant VISTA-ECD-Fc binding to Antibody No. 92. Binding of Ab No. 92 was tested using human VISTA-ECD mutants. Ab No. 92 titrated at 100 ug/mL-0.003 ug/mL was captured on a 96-well plate coated with mutant VISTA-ECDs at 3 ug/mL. Ab No. 92 was detected using biotinylated anti-human Ig light chain kappa followed by streptavidin-HRP and TMB substrate. 450 nm optical density was determined using a CLARIOstar plate reader.
FIG. 8Y. Evaluation of mutant VISTA-ECD-Fc binding to Antibody VSTB174. Binding of VSTB174 was tested using human VISTA-ECD mutants. VSTB174 titrated at 100 ug/mL-0.003 ug/mL was captured on a 96-well plate coated with mutant VISTA-ECDs at 3 ug/mL. VSTB174 was detected using biotinylated anti-human Ig light chain kappa followed by streptavidin-HRP and TMB substrate. 450 nm optical density was determined using a CLARIOstar plate reader.
Figure 8C:
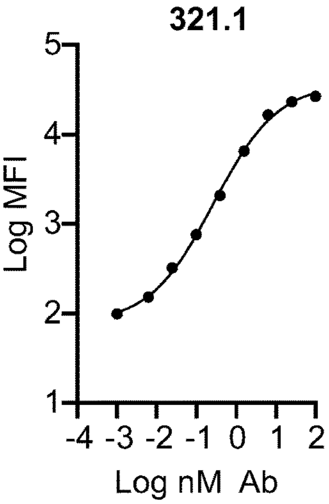
Figure 8D:
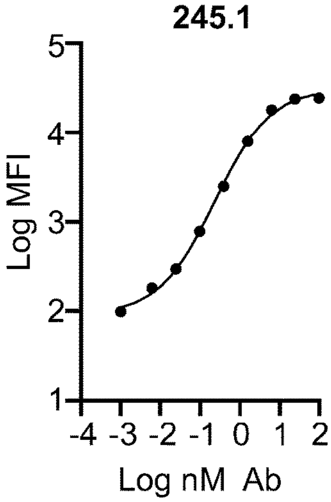
Figure 8E:
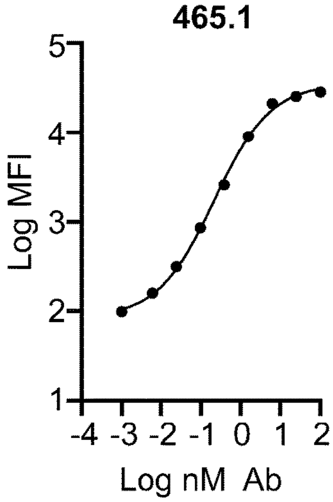
Figure 8F:
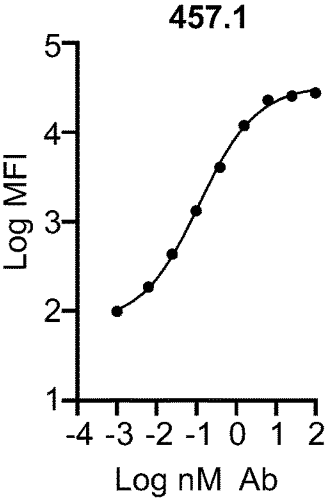
Figure 8G:
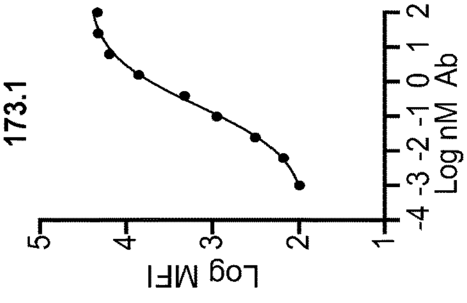
Figure 8H:
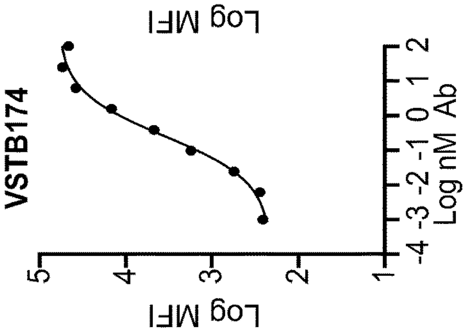
Figure 8I:
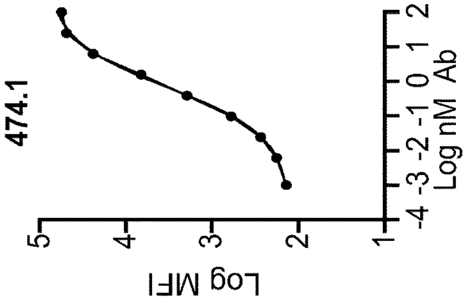
Figure 8M:
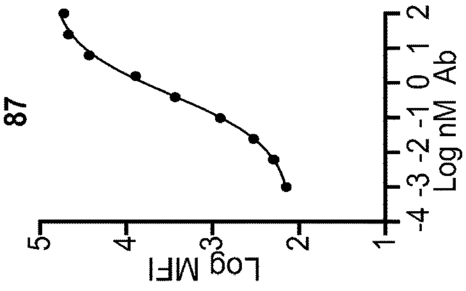
Figure 8N:
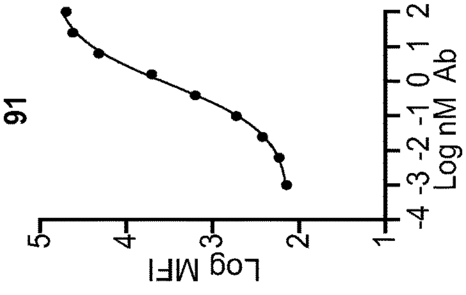
Figure 8O:
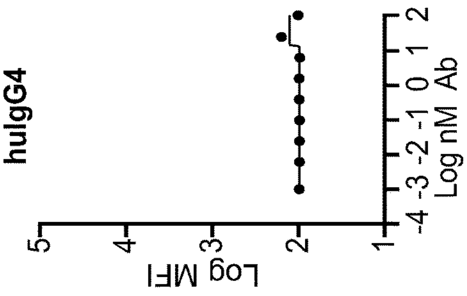
Figure 8J:
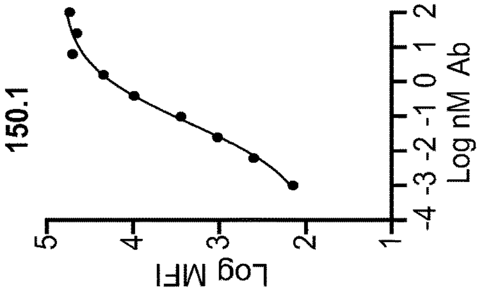
Figure 8K:
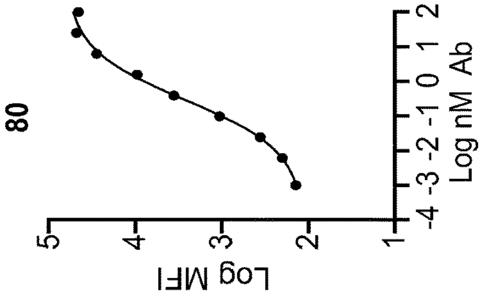
Figure 8L:
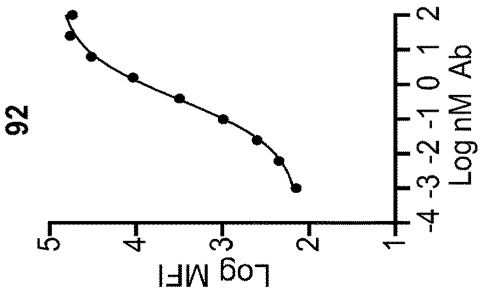
Figure 8P:
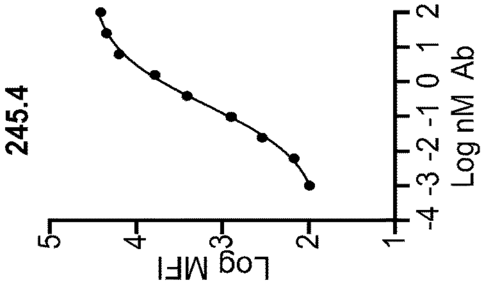
Figure 8Q:
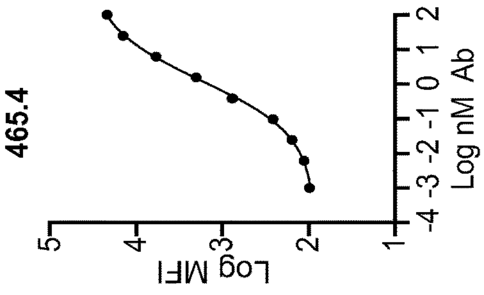
Figure 8R:
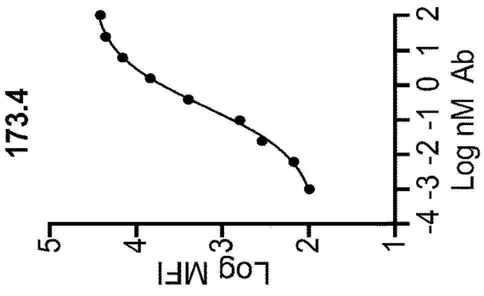
Figure 8S:
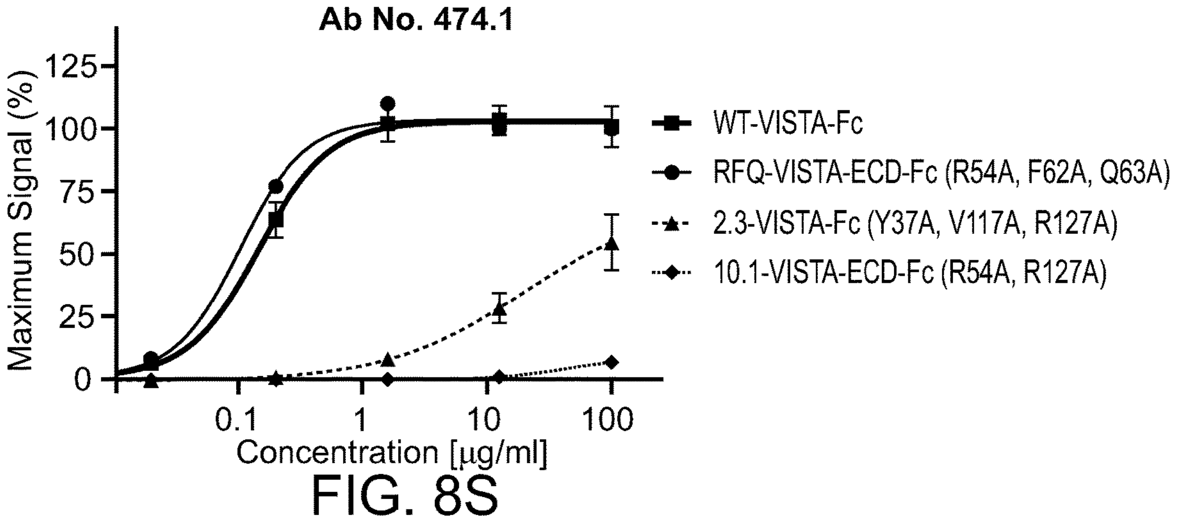
Figure 8T:
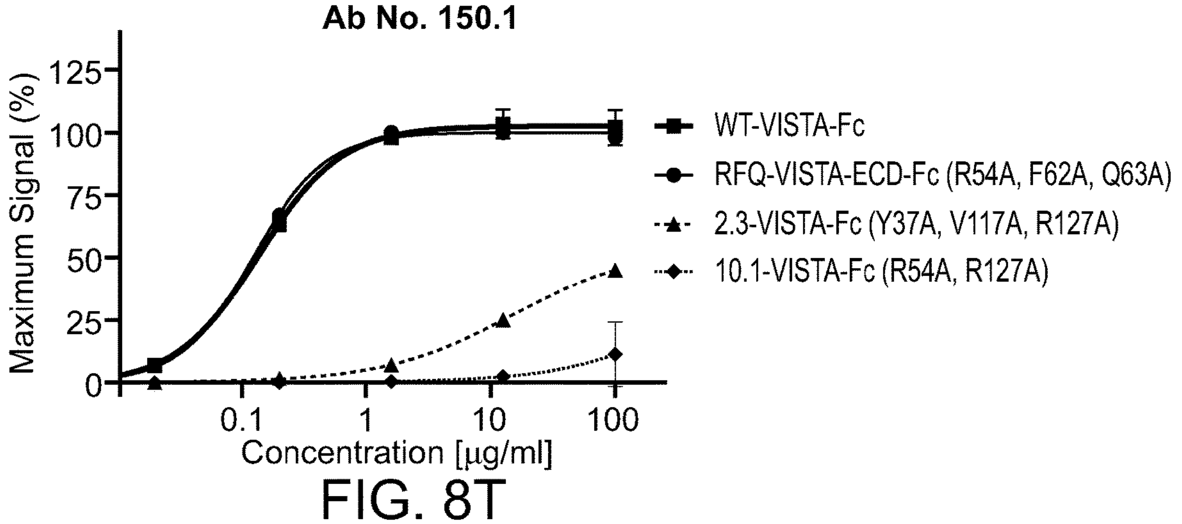
Figure 8U:
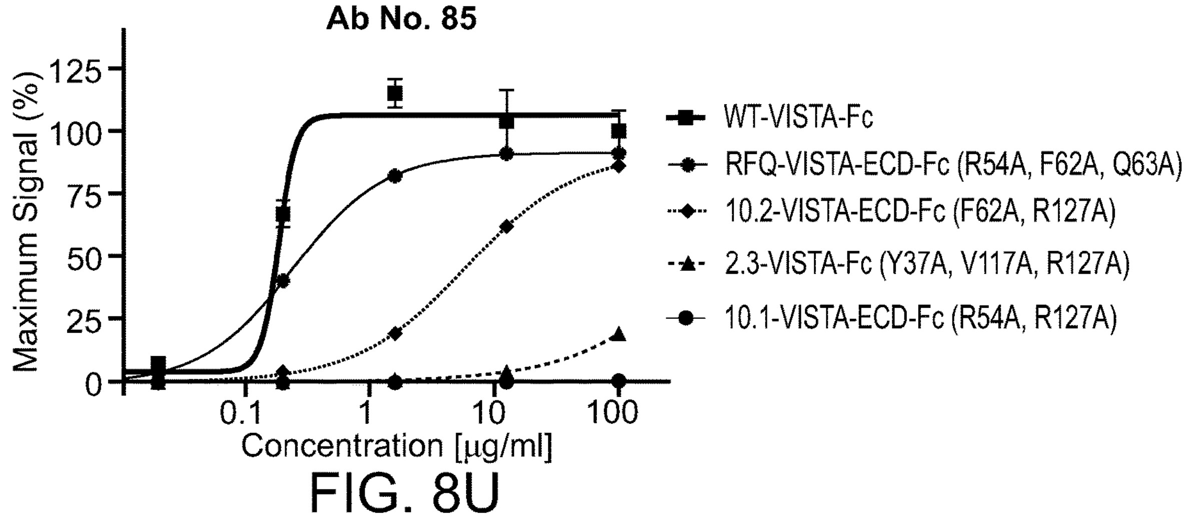
Figure 8V:
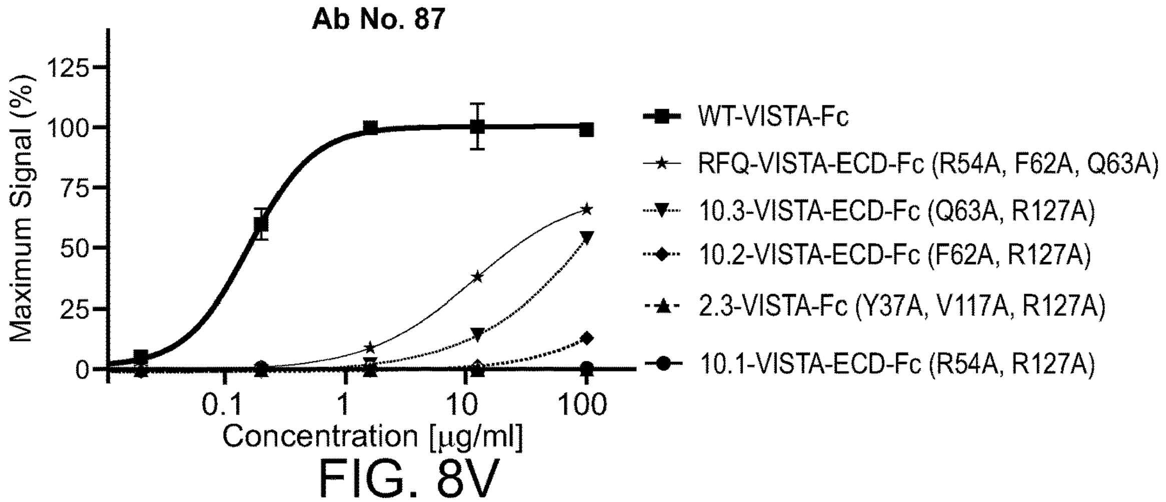
Figure 8W:
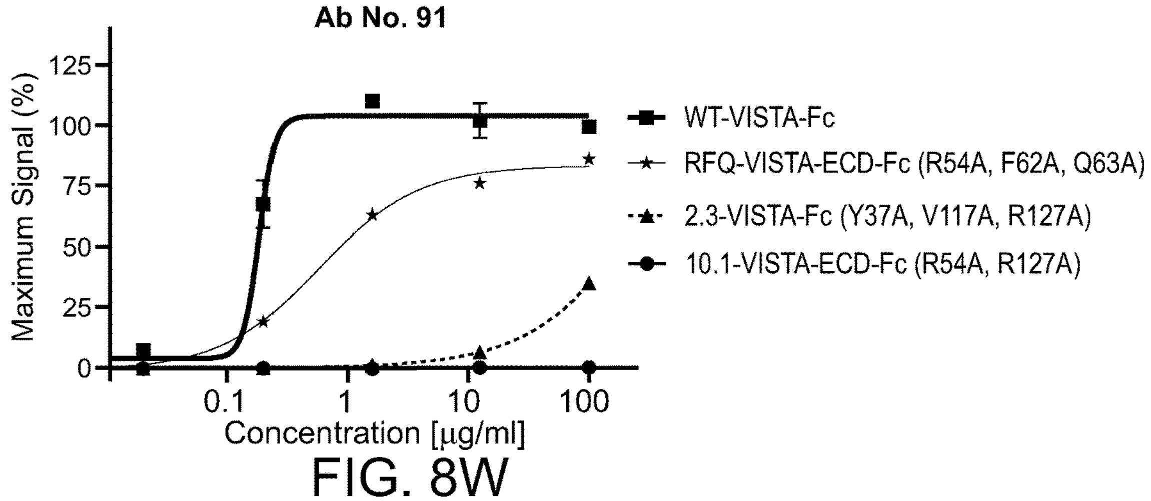
Figure 8X:
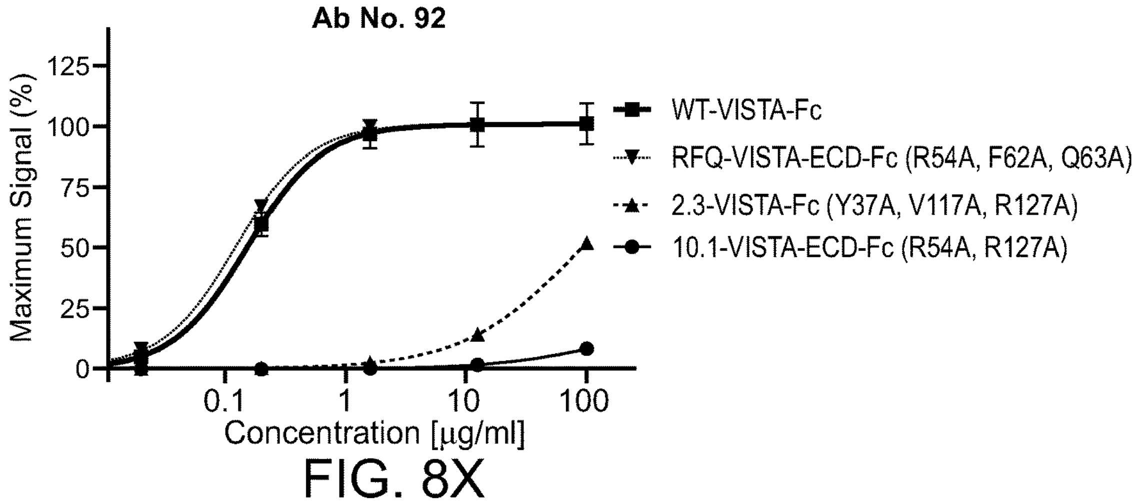
Figure 8Y:
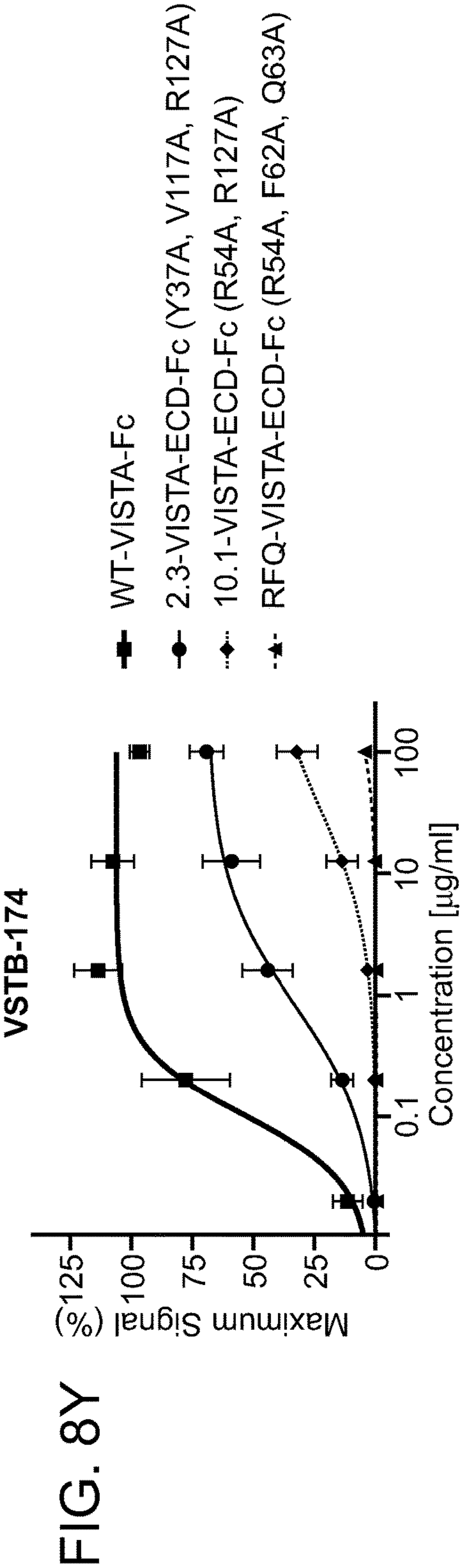
Figure 9A:
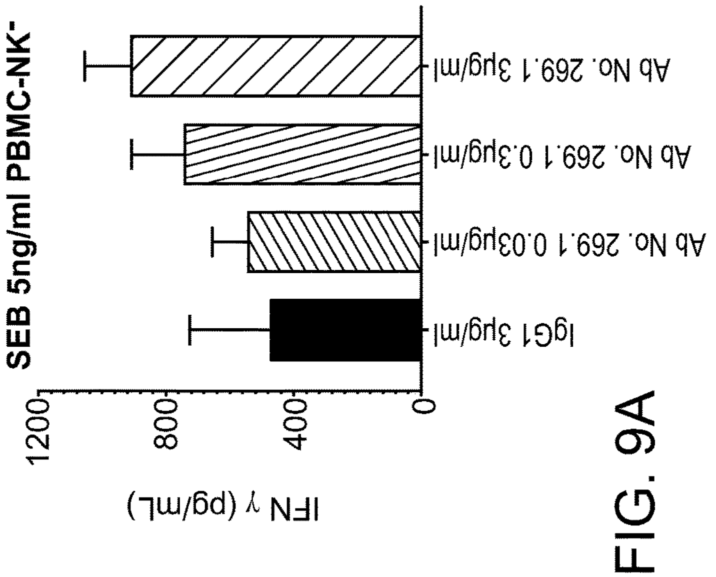
FIGS. 9A and 9B: Effect of antibody No. 269.1 (FIG. 9A) and antibody No. 833.1 (FIG. 9B) on SEB-induced stimulation of NK-depleted human PBMCs on Day 4. Human NK cell-depleted PBMCs were plated at $2\times10^5$ cells/well in the presence of anti-VISTA antibody or control antibodies at 3, 0.3, or 0.03 μg/ml and Staphylococcal enterotoxin B (SEB) at 5 ng/ml for 4 days at 37° C. IFN-γ production at Day 4 was quantified by ELISA (Invitrogen cat #88-7316-88) according to manufacturer's instructions.
Figure 9B:
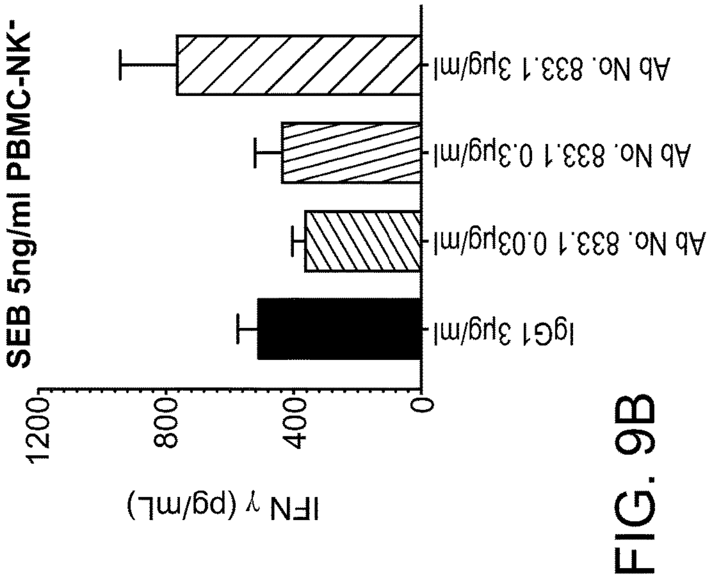
Figure 9C:
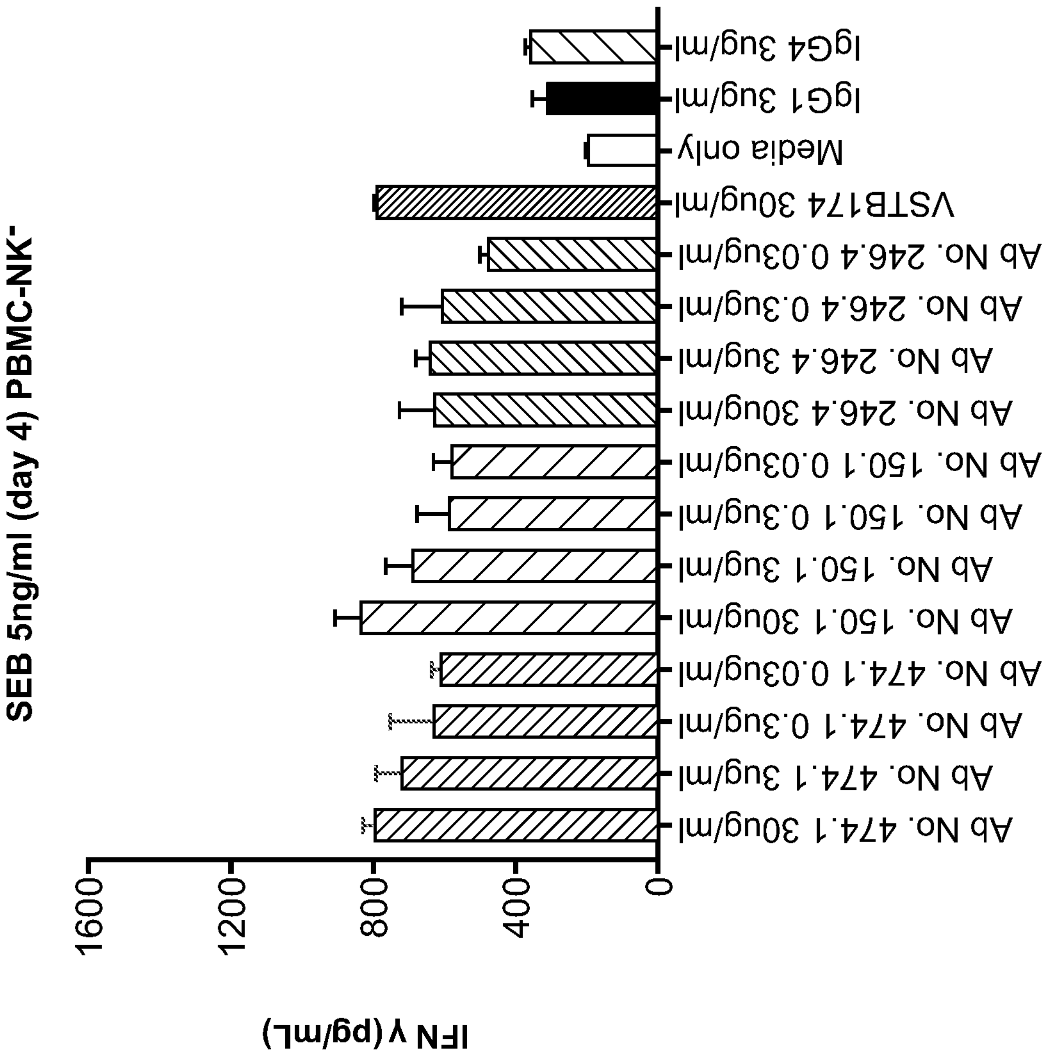
FIG. 9C: Effect of antibody No.474.1 (WT), No. 150.1 (YTE) and No. 246.4 on SEB-induced stimulation of NK cell-depleted human PBMCs at Day 4 compared to VSTB174. Human PBMCs NK cell—depleted were plated at $2\times10^5$ cells/well in the presence of anti-VISTA Abs or control Abs tested at 30, 3, 0.3, and 0.03 ug/ml and SEB at 5 ng/ml for 4 Days at 37° C. IFN-γ production at Day 4 was quantified by ELISA (Invitrogen cat #88-7316-88), according to the manufacturer's instructions.
Figure 10:
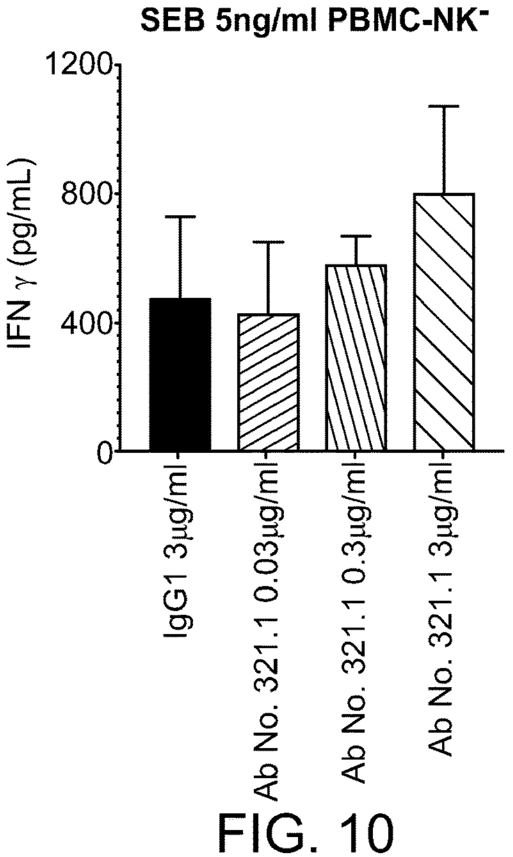
FIG. 10: Effect of antibody No. 321.1 on SEB-induced stimulation of NK-depleted human PBMCs on Day 4. Human NK cell-depleted PBMCs were plated at $2\times10^5$ cells/well in the presence of anti-VISTA antibody or control antibodies tested at 3, 0.3, or 0.03 μg/ml and SEB at 5 ng/ml for 4 days at 37° C. IFN-γ production at Day 4 was quantified by ELISA (Invitrogen cat #88-7316-88) according to manufacturer's instructions.
Figure 11:
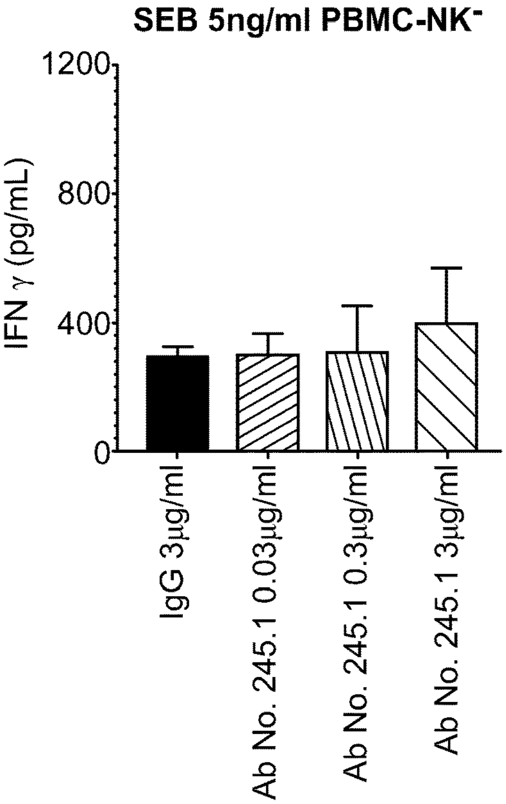
FIG. 11: Effect of antibody No. 245.1 on SEB-induced stimulation of NK-depleted human PBMCs on Day 4. Human NK cell-depleted PBMCs were plated at $2\times10^5$ cells/well in the presence of anti-VISTA antibody or control antibodies at 3, 0.3, or 0.03 μg/ml and SEB at 5 ng/ml for 4 days at 37° C. IFN-γ production at Day 4 was quantified by ELISA (Invitrogen cat #88-7316-88) according to manufacturer's instructions.
Figure 12:
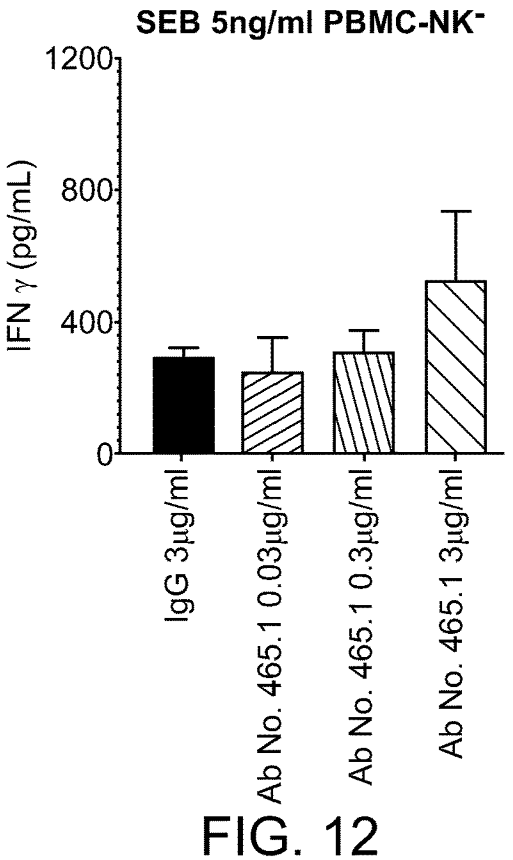
FIG. 12: Effect of antibody No. 465.1 on SEB-induced stimulation of NK-depleted human PBMCs on Day 4. Human NK cell-depleted PBMCs were plated at $2\times10^5$ cells/well in the presence of anti-VISTA antibody or control antibodies at 3, 0.3, or 0.03 μg/ml and SEB at 5 ng/ml for 4 days at 37° C. IFN-γ production at Day 4 was quantified by ELISA (Invitrogen cat 488-7316-88) according to manufacturer's instructions.
Figure 13:
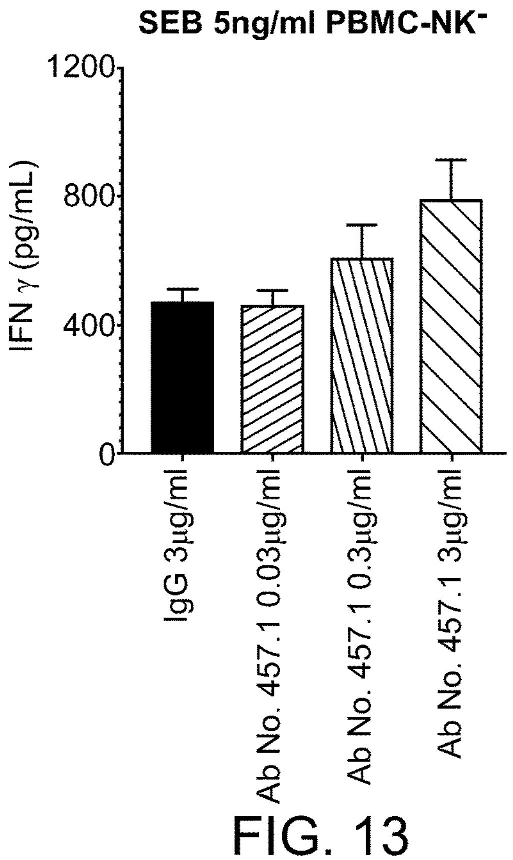
FIG. 13: Effect of antibody No. 457.1 on SEB-induced stimulation of NK-depleted human PBMCs on Day 4. Human NK cell-depleted PBMCs were plated at $2\times10^5$ cells/well in the presence of anti-VISTA antibody or control antibodies tested at 3, 0.3, or 0.03 μg/ml and SEB at 5 ng/ml for 4 days at 37° C. IFN-γ production at Day 4 was quantified by ELISA (Invitrogen cat #88-7316-88) according to manufacturer's instructions.
Figure 14:
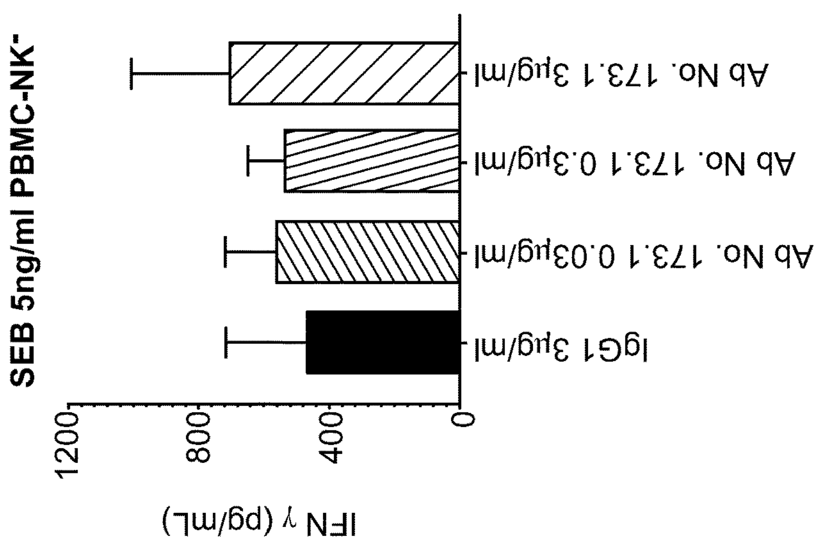
FIG. 14: Effect of antibody No. 173.1 on SEB-induced stimulation of NK-depleted human PBMCs on Day 4. Human NK cell-depleted PBMCs were plated at $2\times10^5$ cells/well in the presence of anti-VISTA antibody or control antibodies at 3, 0.3, or 0.03 μg/ml and SEB at 5 ng/ml for 4 days at 37° C. IFN-γ production at Day 4 was quantified by ELISA (Invitrogen cat #88-7316-88) according to manufacturer's instructions.
Figure 15:
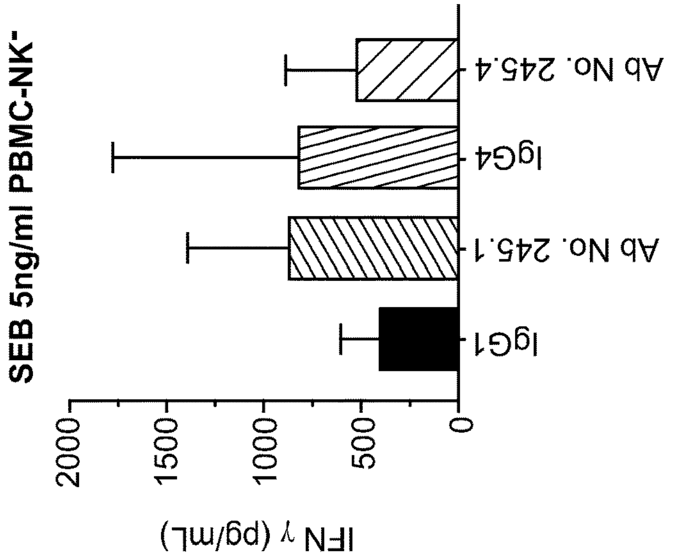
FIG. 15: Effect of antibody No. 245.1 and antibody No. 245.4 on SEB-induced stimulation of NK-depleted human PBMCs on Day 4. Human NK cell-depleted PBMCs were plated at $2\times10^5$ cells/well in the presence of anti-VISTA antibody or control antibodies listed in the figure (3 μg/ml) and SEB at 5 ng/ml for 4 days at 37° C. IFN-γ production at Day 4 was quantified by ELISA (Invitrogen cat #88-7316-88), according to manufacturer's instructions. Antibodies tested are shown on the x-axis.
Figure 16:
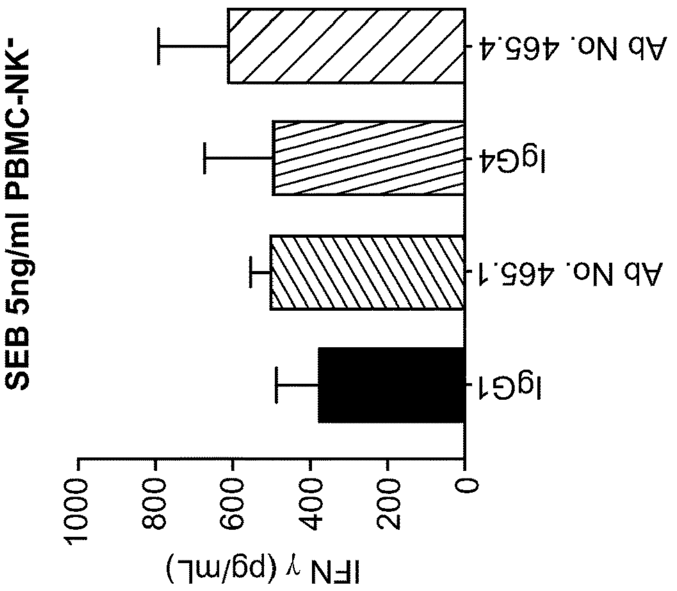
FIG. 16: Effect of antibody No. 465.1 and antibody No. 465.4 on SEB-induced stimulation of NK-depleted human PBMCs on Day 4. Human NK cell-depleted PBMCs were plated at $2\times10^5$ cells/well in the presence of anti-VISTA antibody or control antibodies listed in the figure (3 μg/ml) and SEB at 5 ng/ml for 4 days at 37° C. IFN-γ production at Day 4 was quantified by ELISA (Invitrogen cat #88-7316-88) according to manufacturer's instructions. Antibodies tested are shown on the x-axis.
Figure 17:
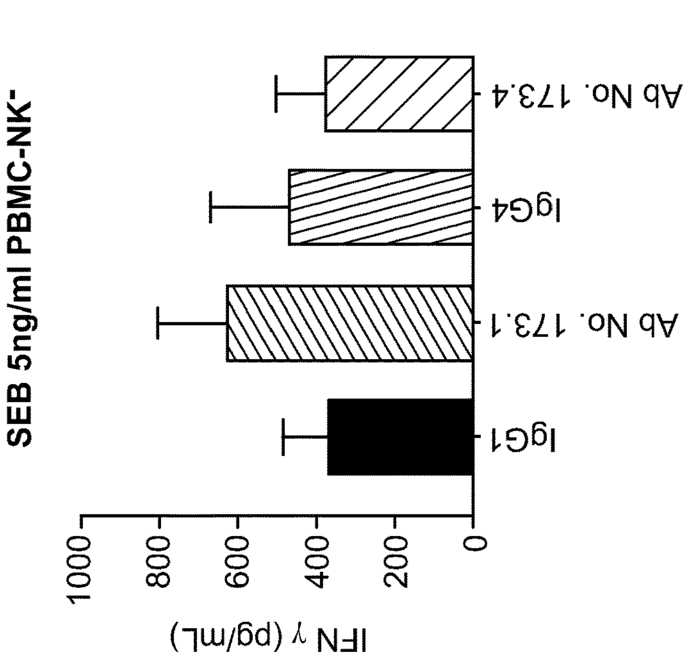
FIG. 17: Effect of antibody No. 173.1 and antibody No. 173.4 on SEB-induced stimulation of NK-depleted human PBMCs on Day 4. Human NK cell-depleted PBMCs were plated at $2\times10^5$ cells/well in the presence of anti-VISTA antibody or control antibodies listed in the figure (3. μg/ml) and SEB at 5 ng/ml for 4 days at 37° C. IFN-γ production at Day 4 was quantified by ELISA (Invitrogen cat #88-7316-88) according to manufacturer's instructions. Antibody Nos. tested are shown on the x-axis.
Figure 18A:
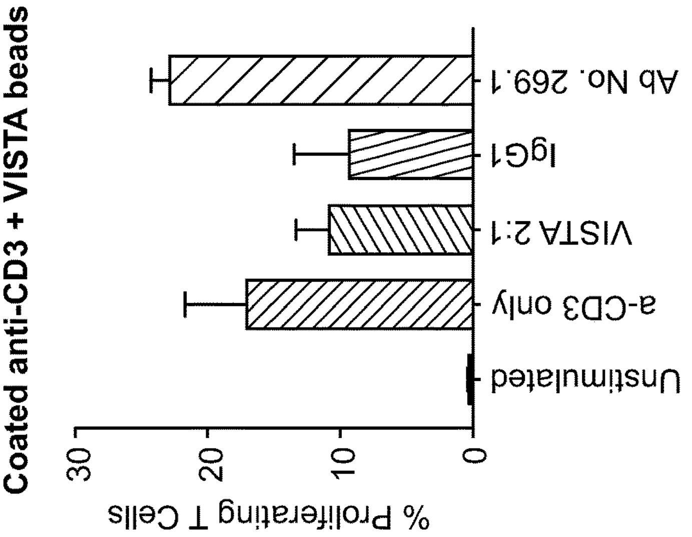
FIGS. 18A and 18B. Effect of anti-VISTA antibody No. 269.1 on reversal of VISTA-mediated suppression of T cell activation. $2\times10^5$ Cell Trace Violet-labeled human pan T cells were cultured in plates coated with antibody ("Ab") to CD3 in the presence of VISTA-coated beads (2:1 ratio of beads to cells) and antibody No. 269.1 or control Ab at 100 μg/ml, for 24 hrs. T cell proliferation was quantified by Flow Cytometry and IFNγ was quantified by ELISA (R&D Systems, catalog #DY285B-05).
Figure 18B:
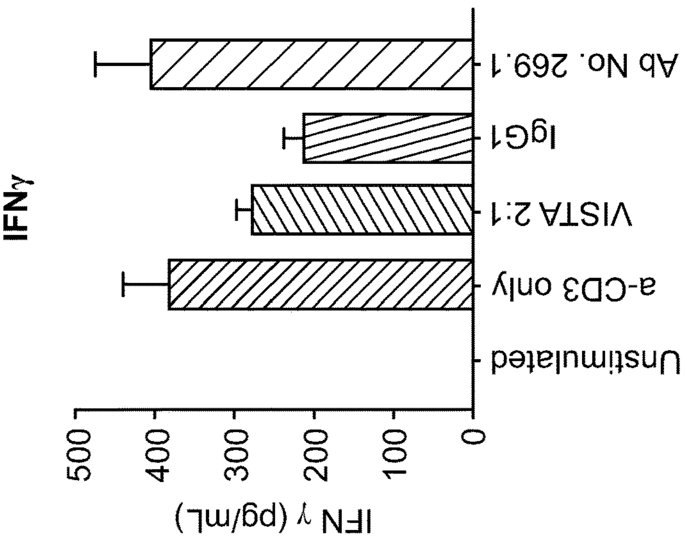
Figure 20A:
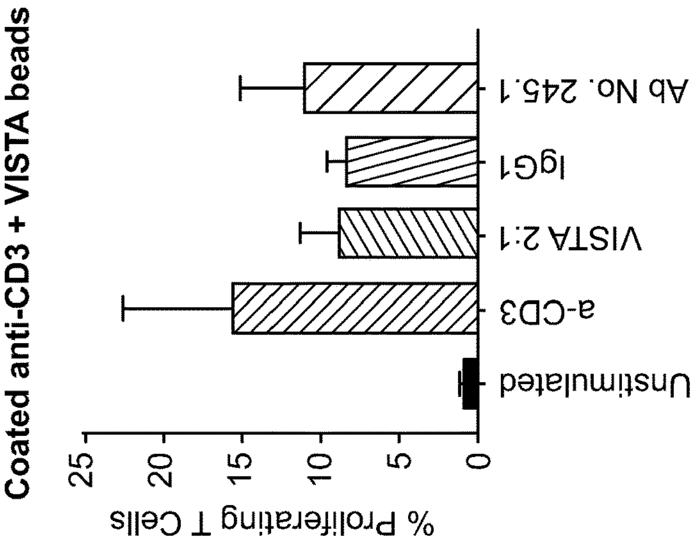
FIGS. 20A and 20B. Effect of anti-VISTA antibody No. 245.1 on reversal of VISTA-mediated suppression of T cell activation. $2\times10^5$ Cell Trace Violet-labeled human pan T cells were cultured in anti-CD3 Ab-coated plates in the presence of VISTA-coated beads (2:1 ratio of beads to cells) and Antibody No. 245.1 or control Ab at 100 μg/ml for 24 hrs. T cell proliferation was quantified by Flow Cytometry and IFNγ was quantified by ELISA (R&D Systems, cat #DY285B-05).
Figure 19B:
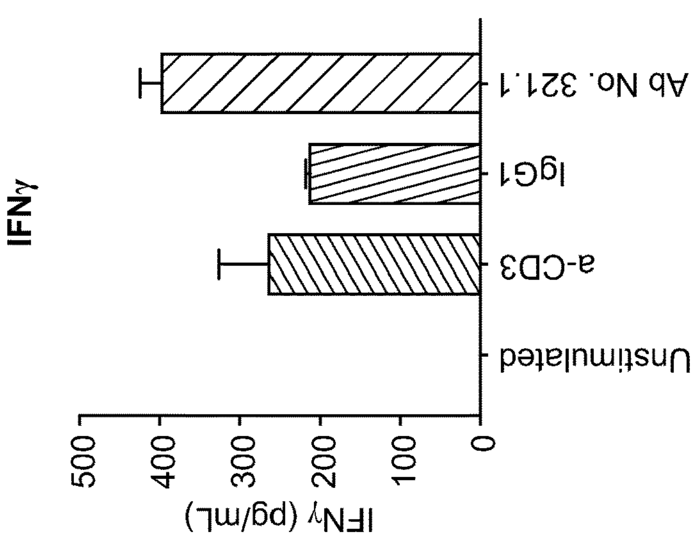
FIGS. 19A and 19B. Effect of anti-VISTA antibody No. 321.1 on reversal of VISTA-mediated suppression of T cell activation. $2\times10^5$ Cell Trace Violet-labeled human pan T cells were cultured in anti-CD3 Ab-coated plates in the presence of VISTA-coated beads (2:1 ratio of beads to cells) and antibody No. 321.1 or control Ab at 100 μg/ml, for 24 hrs. T cell proliferation was quantified by Flow Cytometry and IFNγ was quantified by ELISA (R&D Systems, cat #DY285B-05).
Figure 19A:
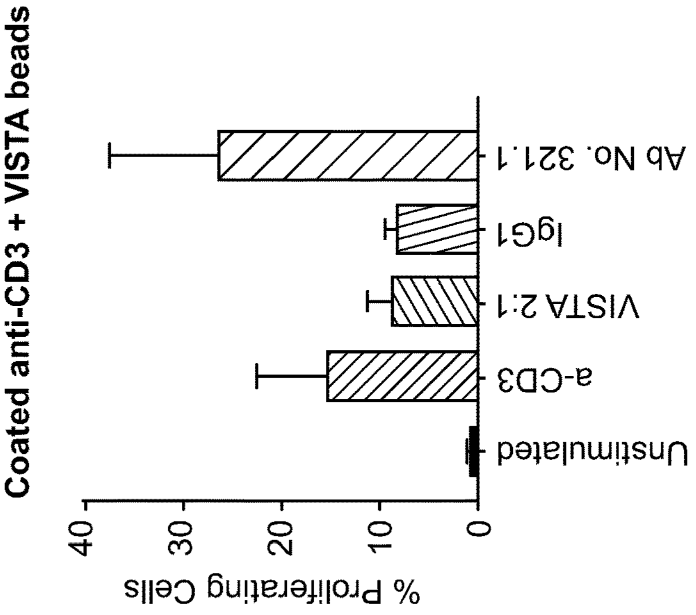
Figure 21B:
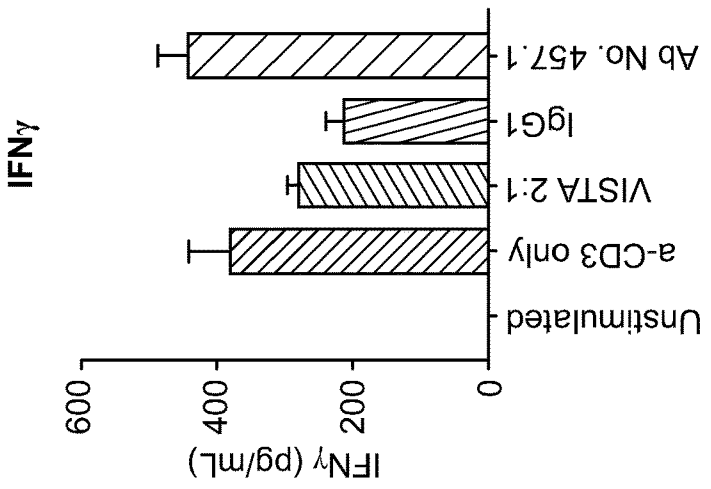
FIGS. 21A and 21B. Effect of anti-VISTA antibody No. 457.1 on reversal of VISTA-mediated suppression of T cell activation. $2\times10^5$ Cell Trace Violet-labeled human pan T cells were cultured in anti-CD3 Ab-coated plates in the presence of VISTA-coated beads (2:1 ratio of beads to cells) and Antibody No.457.1 or control Ab at 100 μg/ml, for 24 hrs. T cell proliferation was quantified by Flow Cytometry and IFNγ was quantified by ELISA (R&D Systems, cat #DY285B-05).
Figure 21A:
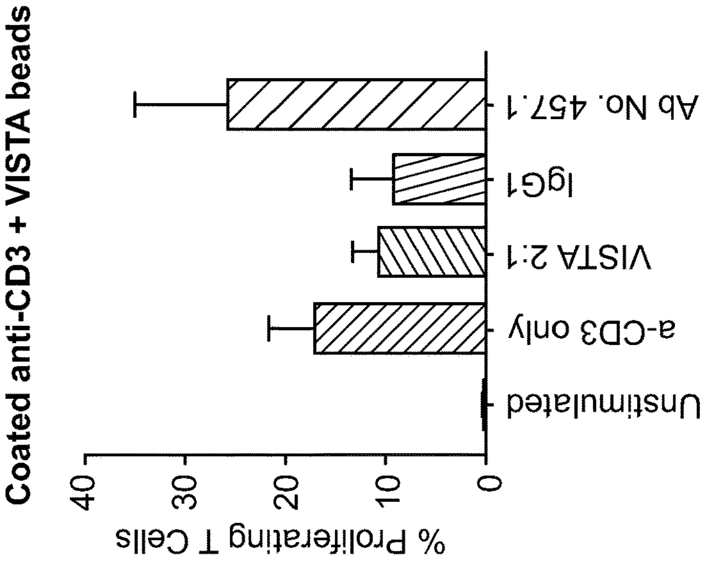
Figure 20B:
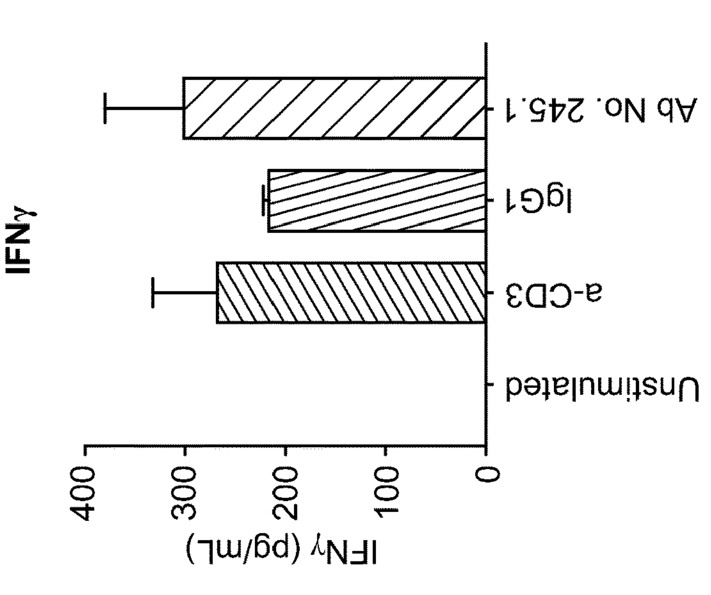
Figure 23A:
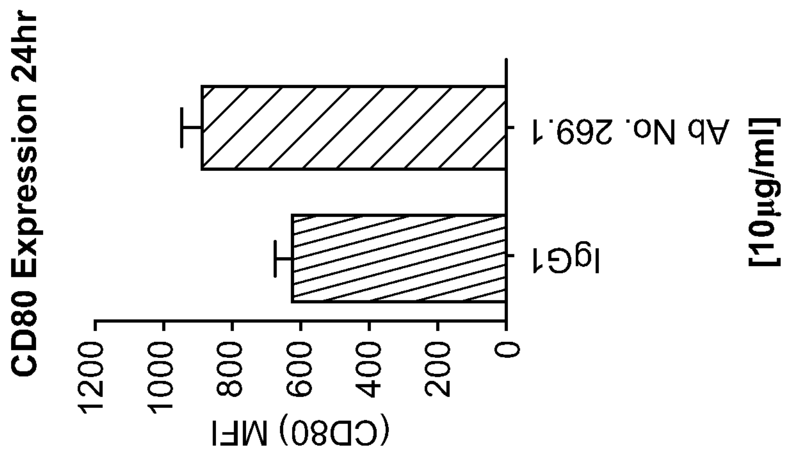
FIGS. 23A-23D. Effect of anti-VISTA antibody No. 269.1 on upregulation of activation markers CD80, CD86, and HLA-DR on CD14+ monocytes and on CXCL10 secretion in co-culture at 24 hrs. $0.5\times10^5$ CD14+ enriched human PBMCs were co-cultured with $2\times10^5$ human PBMCs from the same donor in the presence of antibody No. 269.1 or control Ab at 10 μg/ml for 24 hrs. Upregulation of activation markers on CD14+ cells at 24 hrs was quantified by Flow Cytometry on gated CD14+ live cells. Expression of CD80, CD86 and HLA-DR on CD14+ cells was quantified by Mean Fluorescence Intensity (MFI). CXCL10 secretion in co-culture at 24 hrs was quantified by ELISA (R&D Systems, catalog #DY266-05).
Figure 22B:
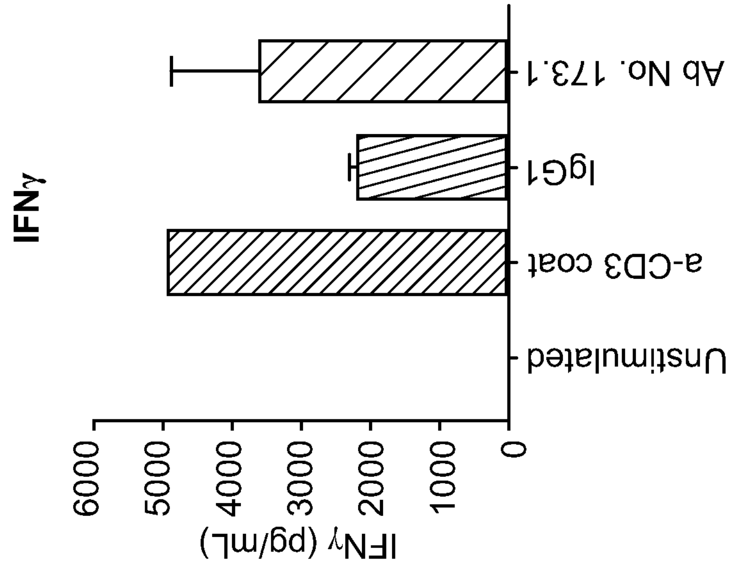
FIGS. 22A and 22B. Effect of anti-VISTA antibody No. 173.1 on reversal of VISTA-mediated suppression of T cell activation. $2\times10^5$ Cell Trace Violet-labeled human pan T cells were cultured in anti-CD3 Ab-coated plates in the presence of VISTA-coated beads and Antibody No.173.1 or control Ab at 100 μg/ml, for 24 hrs. T cell proliferation was quantified by Flow Cytometry and IFNγ was quantified by ELISA (R&D Systems, catalog #DY285B-05).
Figure 22A:
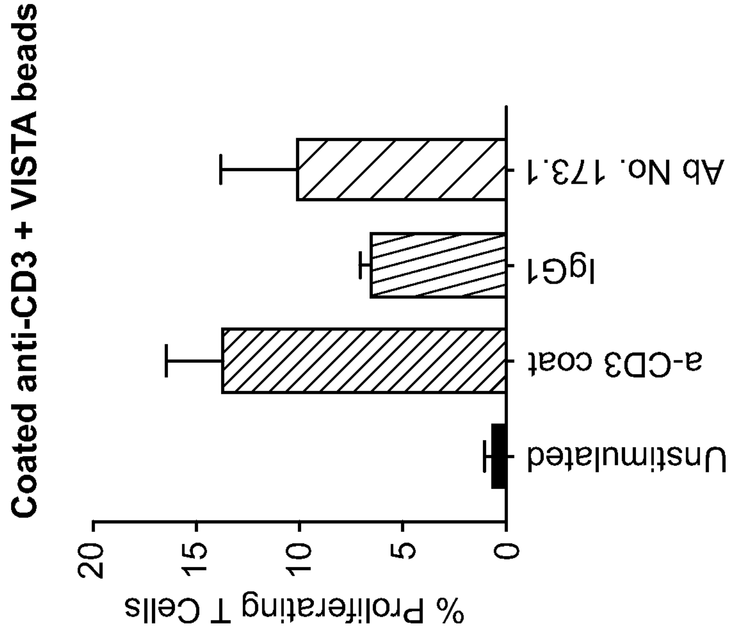
Figure 23B:
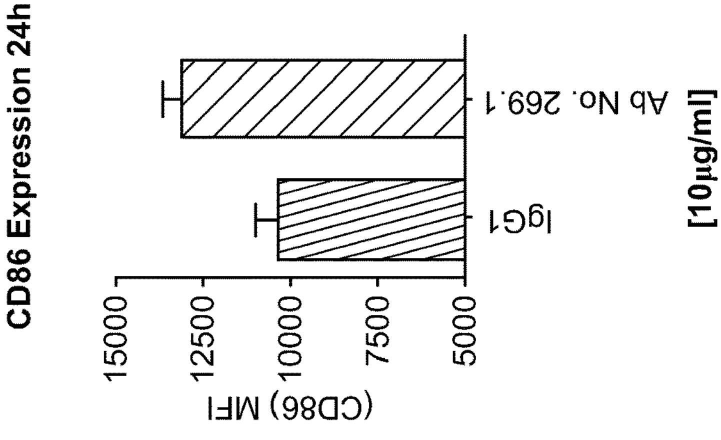
Figure 23C:
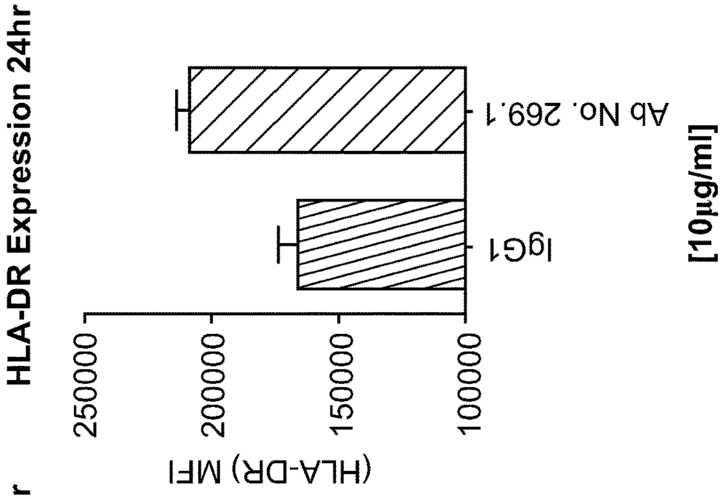
Figure 23D:
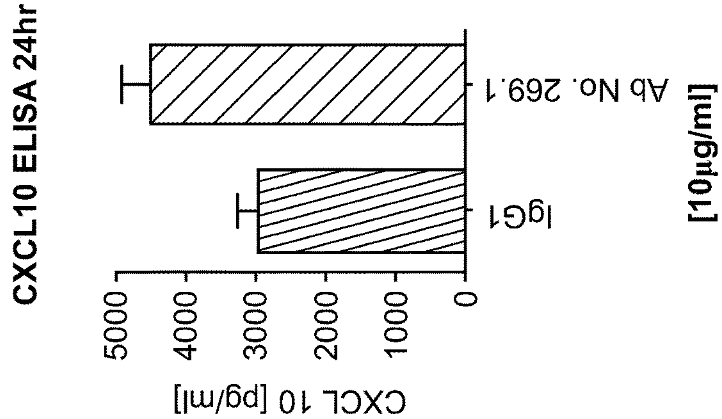
Figure 24A:
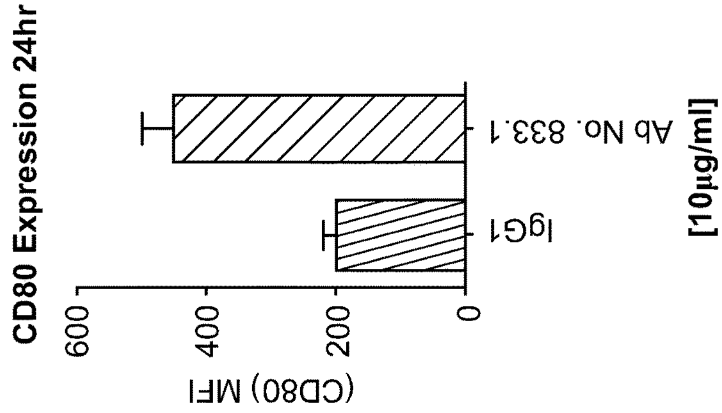
FIGS. 24A-24C. Effect of anti-VISTA antibody No. 833.1 on upregulation of activation markers CD80 and HLA-DR on CD14+ monocytes and CXCL10 secretion in co-culture at 24 hrs. $0.5\times10^5$ CD14+ enriched human PBMCs were co-cultured with $2\times10^5$ human PBMCs from the same donor in the presence of antibody No. 833.1 or control Ab at 10 μg/ml for 24 hrs. Upregulation of activation markers on CD14+ cells at 24 hrs was quantified by Flow Cytometry on gated CD14+ live cells. Expression of CD80 and HLA-DR on CD14+ cells was quantified by Mean Fluorescence Intensity (MFI). CXCL10 secretion in co-culture at 24 hrs was quantified by ELISA (R&D Systems, catalog #DY266-05).
Figure 24B:
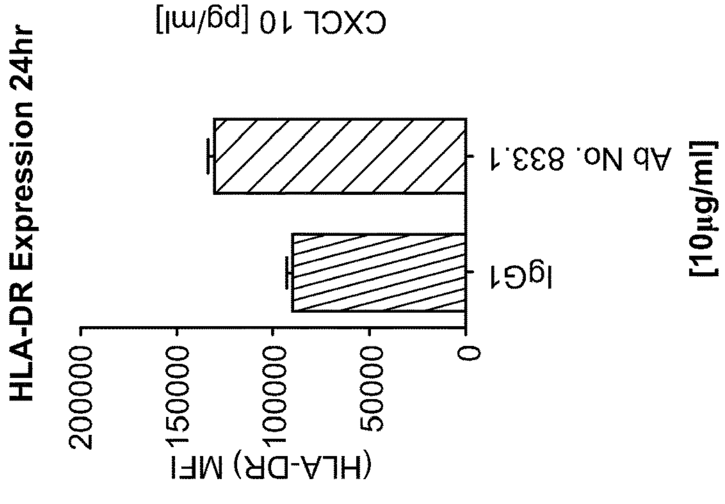
Figure 24C:
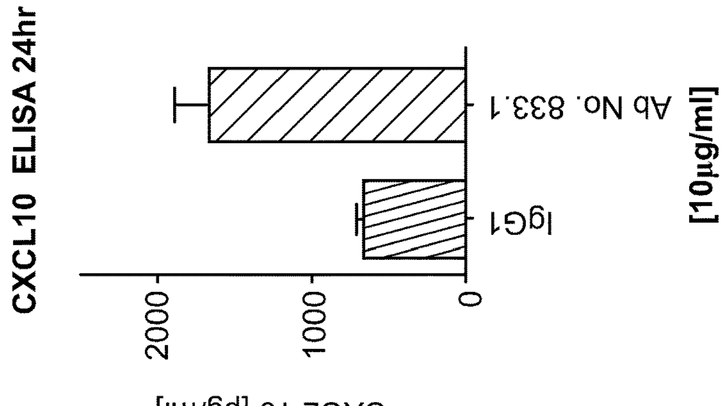
Figure 25A:
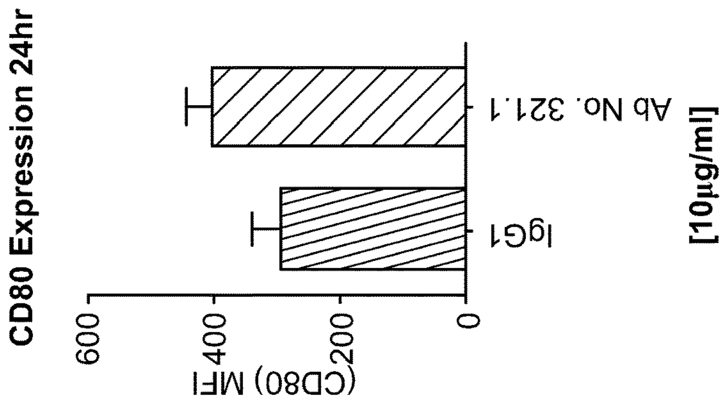
FIGS. 25A-25D. Effect of anti-VISTA antibody No. 321.1 on upregulation of activation markers CD80, CD86, and HLA-DR on CD14+ monocytes and CXCL10 secretion in co-culture at 24 hrs. $0.5\times10^5$ CD14+ enriched human PBMCs were co-cultured with $2\times10^5$ human PBMCs from the same donor in the presence of antibody No. 321.1 or control Ab at 10 μg/ml for 24 hrs. Upregulation of activation markers on CD14+ cells at 24 hrs was quantified by Flow Cytometry on gated CD14+ live cells. Expression of CD80, CD86 and HLA-DR on CD14+ cells was quantified by Mean Fluorescence Intensity (MFI). CXCL10 secretion in co-culture at 24 hrs was quantified by ELISA (R&D Systems, catalog #DY266-05).
Figure 25B:
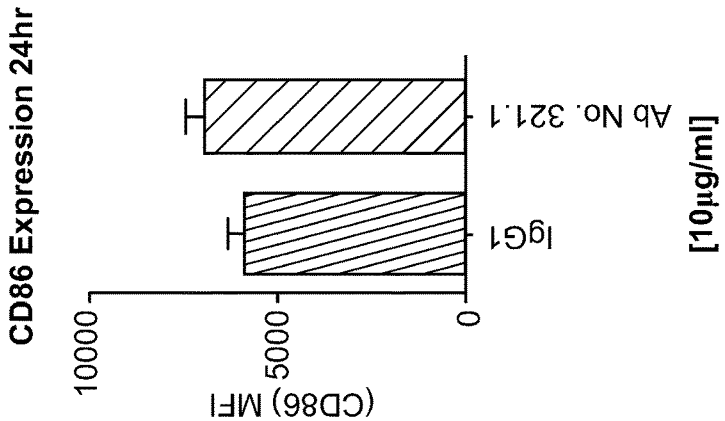
Figure 25C:
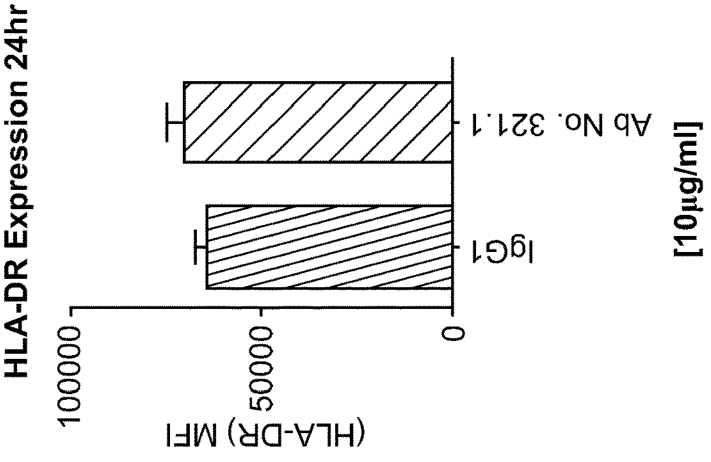
Figure 25D:
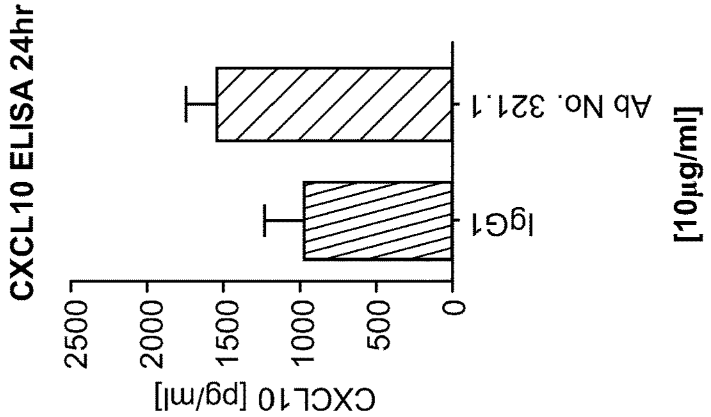
Figure 26A:
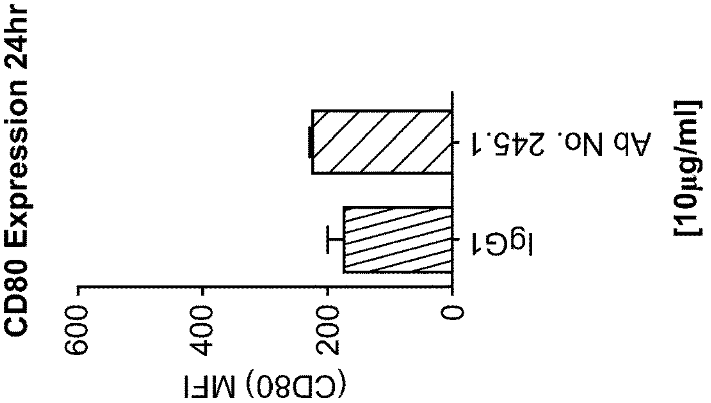
FIGS. 26A-26C. Effect of anti-VISTA antibody No. 245.1 on upregulation of activation markers CD80 and HLA-DR on CD14+ monocytes and CXCL10 secretion in co-culture at 24 hrs. $0.5\times10^5$ CD14+ enriched human PBMCs were co-cultured with $2\times10^5$ human PBMCs from the same donor in the presence of antibody No. 245.1 or control Ab at 10 μg/ml for 24 hrs. Upregulation of activation markers on CD14+ cells at 24 hrs was quantified by Flow Cytometry on gated CD14+ live cells. Expression of CD80 and HLA-DR on CD14+ cells was quantified by Mean Fluorescence Intensity (MFI). CXCL10 secretion in co-culture at 24 hrs was quantified by ELISA (R&D Systems, catalog #DY266-05).
Figure 26B:
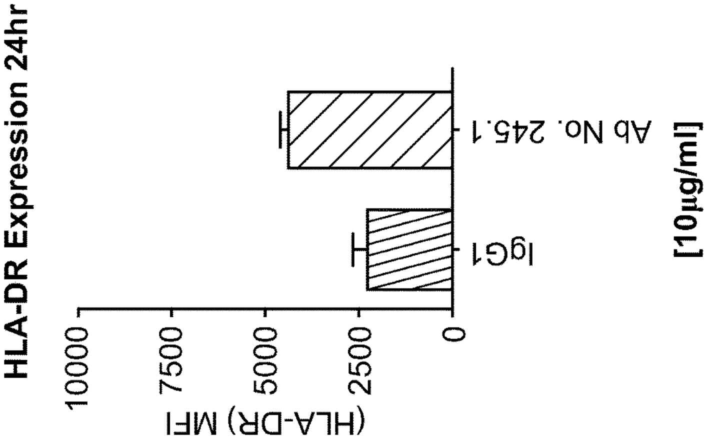
Figure 26C:
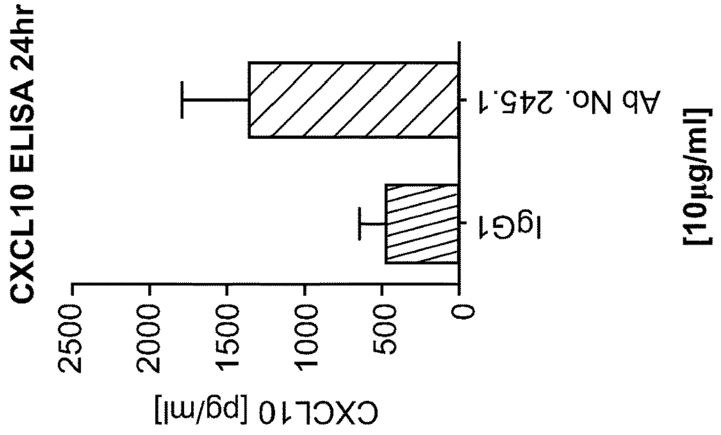
Figure 27A:
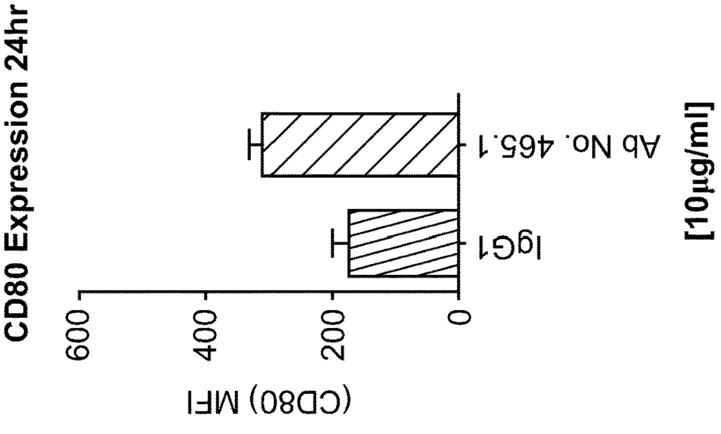
FIGS. 27A-27C. Effect of anti-VISTA antibody No. 465.1 on upregulation of activation markers CD80 and HLA-DR on CD14+ monocytes and CXCL10 secretion in co-culture at 24 hrs. $0.5\times10^5$ CD14+ enriched human PBMCs were co-cultured with $2\times10^5$ human PBMCs from the same donor in the presence of antibody No. 465.1 or control Ab at 10 μg/ml for 24 hrs. Upregulation of activation markers on CD14+ cells at 24 hrs was quantified by Flow Cytometry on gated CD14+ live cells. Expression of CD80 and HLA-DR on CD14+ cells was quantified by Mean Fluorescence Intensity (MFI). CXCL10 secretion in co-culture at 24 hrs was quantified by ELISA (R&D Systems, catalog #DY266-05).
Figure 27B:
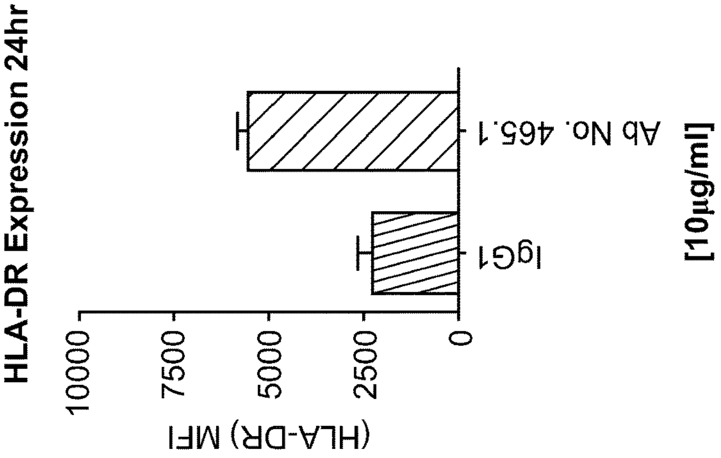
Figure 27C:
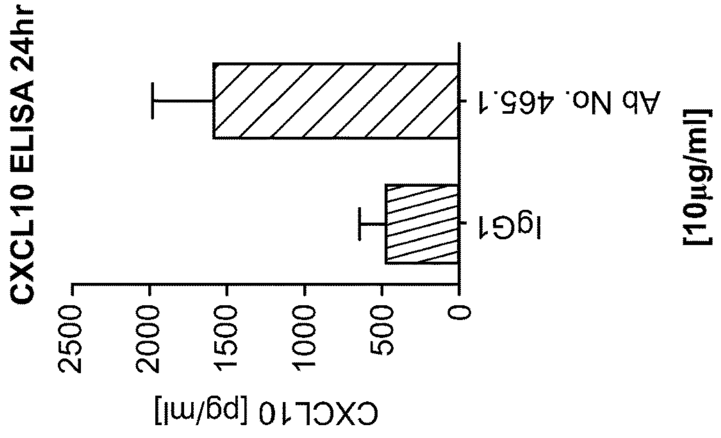
Figure 28A:
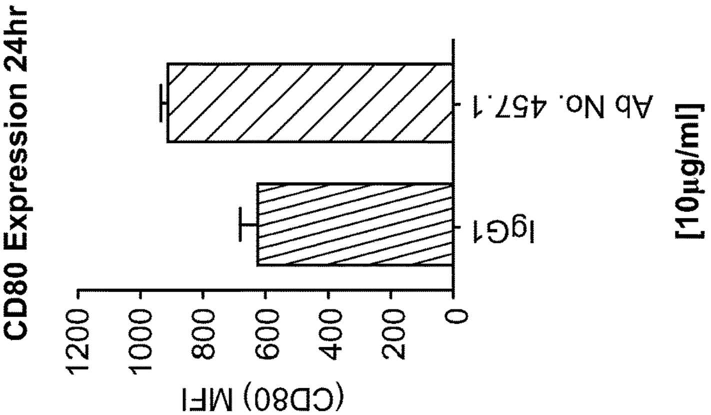
FIGS. 28A-28D. Effect of anti-VISTA antibody No. 457.1 on upregulation of activation markers CD80, CD86, and HLA-DR on CD14+ monocytes and CXCL10 secretion in co-culture at 24 hrs. $0.5\times10^5$ CD14+ enriched human PBMCs were co-cultured with $2\times10^5$ human PBMCs from the same donor in the presence of antibody No. 457.1 or control Ab at 10 μg/ml for 24 hrs. Upregulation of activation markers on CD14+ cells at 24 hrs was quantified by Flow Cytometry on gated CD14+ live cells. Expression of CD80, CD86 and HLA-DR on CD14+ cells was quantified by Mean Fluorescence Intensity (MFI). CXCL10 secretion in co-culture at 24 hrs was quantified by ELISA (R&D Systems, catalog #DY266-05).
Figure 28B:
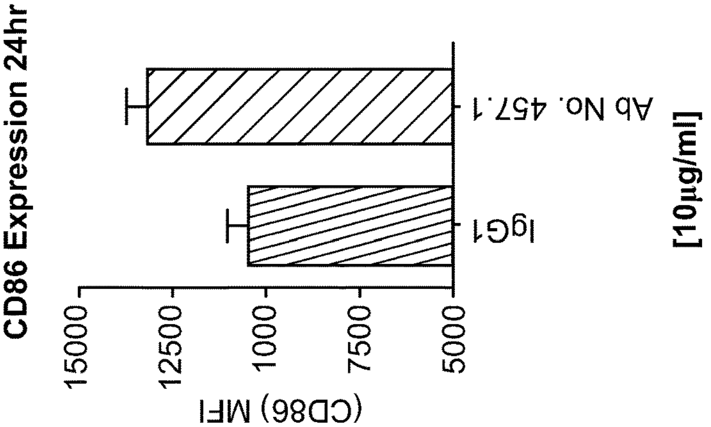
Figure 28C:
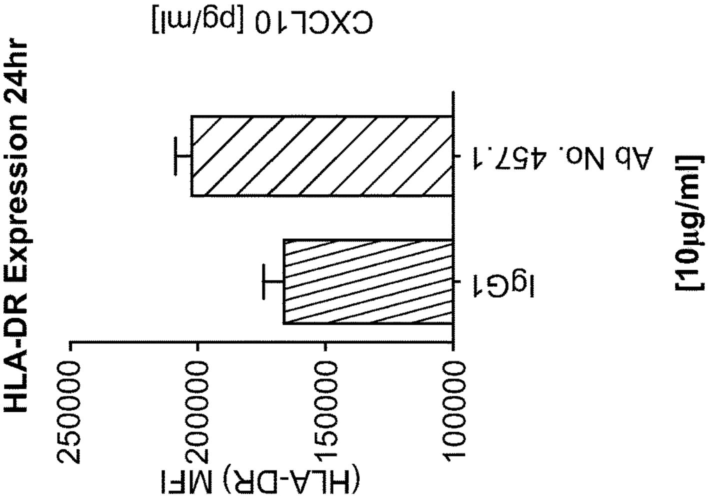
Figure 28D:
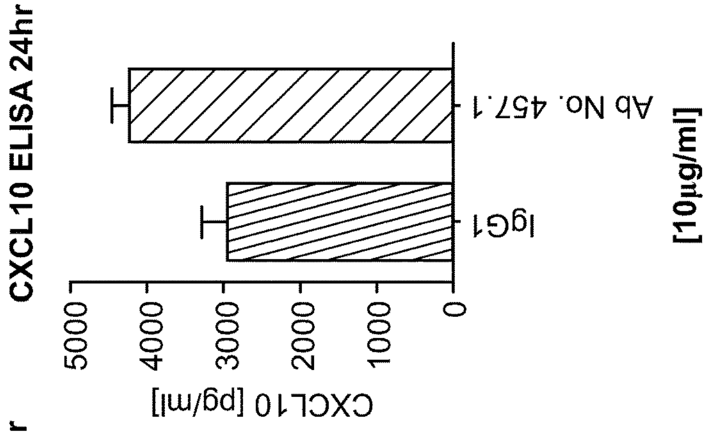
Figure 29A:
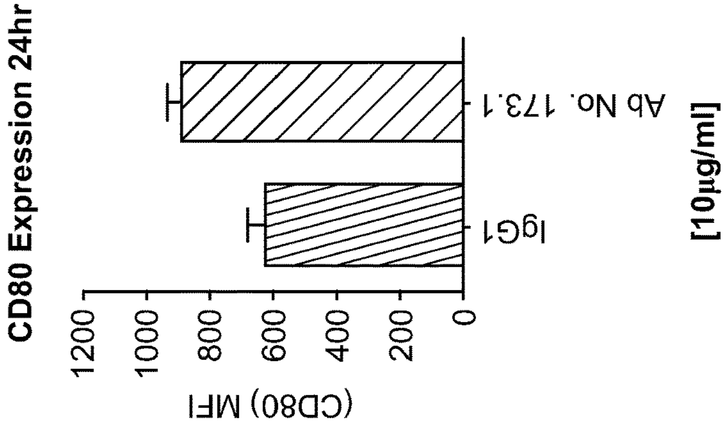
FIGS. 29A-29D. Effect of anti-VISTA antibody No. 173.1 on upregulation of activation markers CD80, CD86, and HLA-DR on CD14+ monocytes and CXCL10 secretion in co-culture at 24 hrs. $0.5\times10^5$ CD14+ enriched human PBMCs were co-cultured with $2\times10^5$ human PBMCs from the same donor in the presence of antibody No. 173.1 or control Ab at 10 μg/ml for 24 hrs. Upregulation of activation markers on CD14+ cells at 24 hrs was quantified by Flow Cytometry on gated CD14+ live cells. Expression of CD80, CD86 and HLA-DR on CD14+ cells was quantified by Mean Fluorescence Intensity (MFI). CXCL10 secretion in co-culture at 24 hrs was quantified by ELISA (R&D Systems, catalog #DY266-05).
Figure 29B:
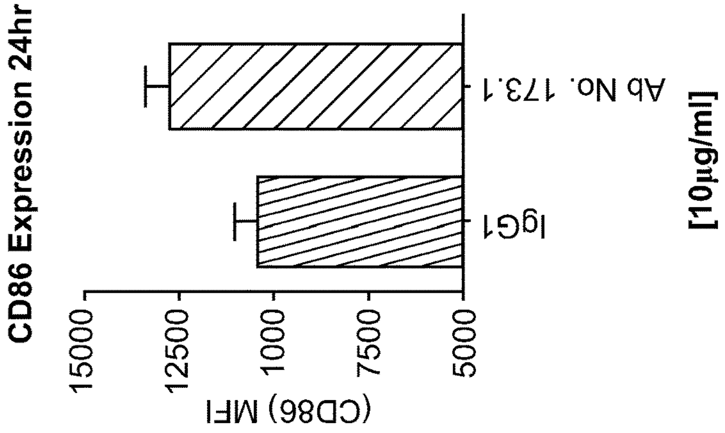
Figure 29C:
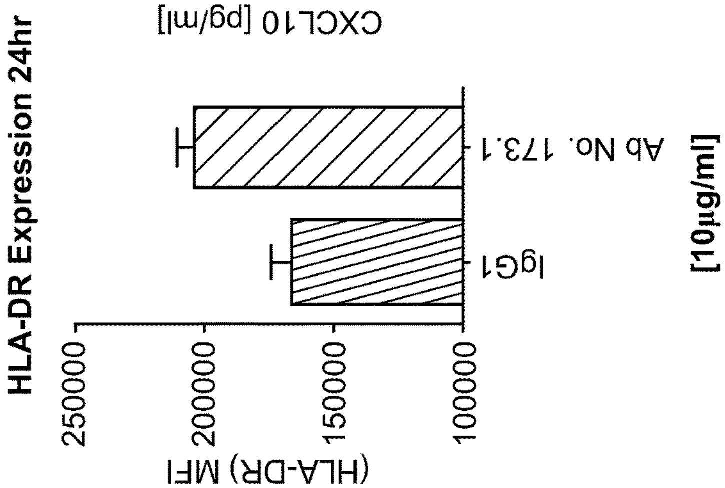
Figure 29D:
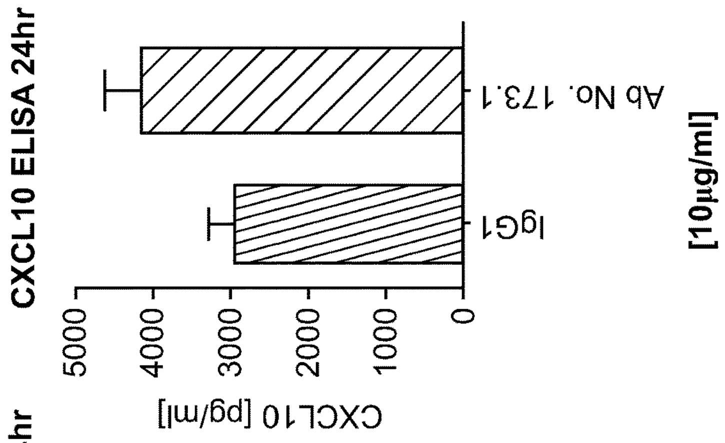
Figure 30A:
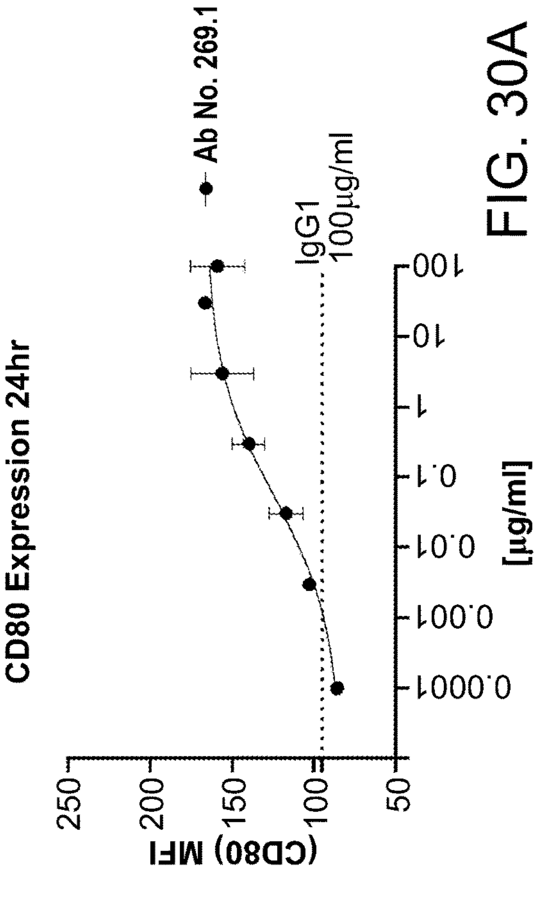
FIGS. 30A-30C. Dose-response effect of anti-VISTA antibody No. 269.1 on upregulation of activation markers HLA-DR and CD80 on CD14+ monocytes and dose-response effect of anti-VISTA antibodies on secretion of CXCL10 in co-culture at 24 hrs. $0.5\times10^5$ CD14+ enriched human PBMCs were co-cultured with $2\times10^5$ human PBMCs from the same donor in the presence of Antibody No. 269.1 or control Ab at 30, 3, 0.3, 0.03, or 0.003 μg/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-15).
Figure 30B:
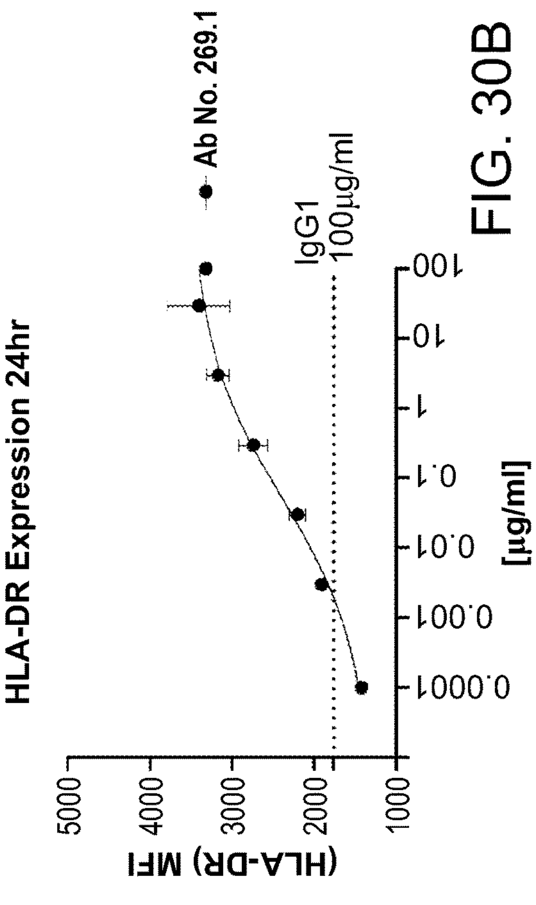
Figure 30C:
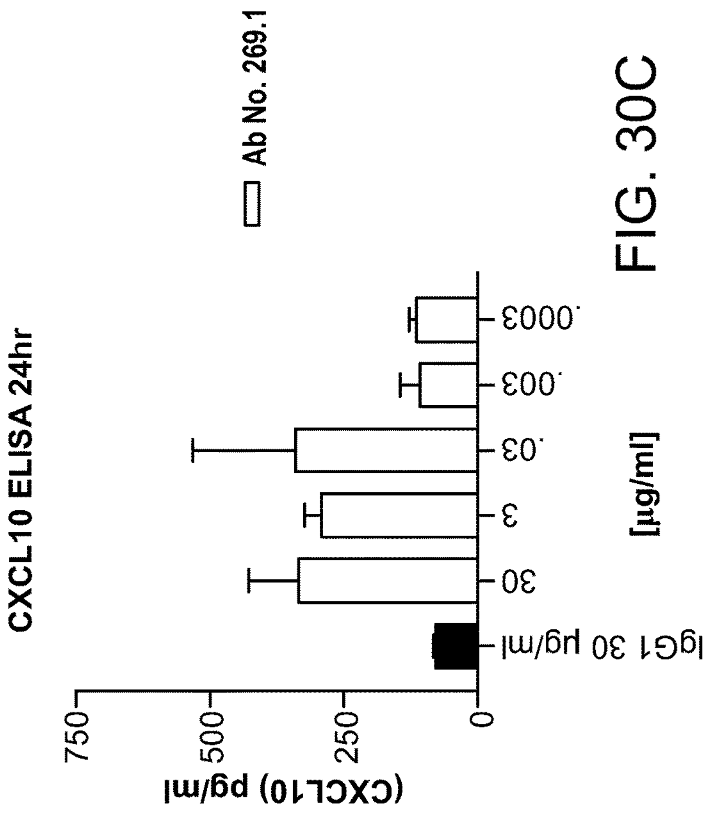
Figure 31A:
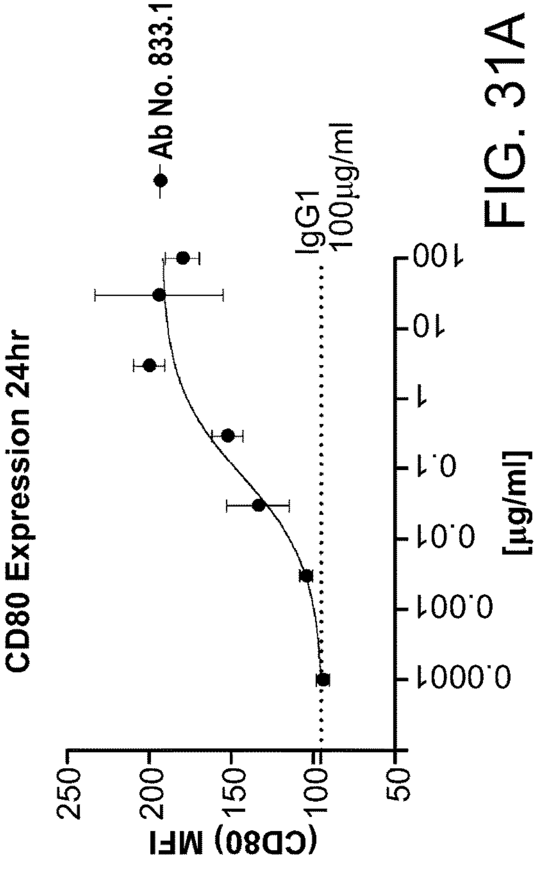
FIGS. 31A-31C. Dose-response effect of anti-VISTA antibody No. 833.1 on upregulation of activation markers HLA-DR and CD80 on CD14+ monocytes and dose-response effect of anti-VISTA antibodies on secretion of CXCL10 in co-culture at 24 hrs. $0.5\times10^5$ CD14+ enriched human PBMCs were co-cultured with $2\times10^5$ human PBMCs from the same donor in the presence of antibody No. 833.1 or control Ab at 30, 3, 0.3, 0.03, or 0.003 μg/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-15).
Figure 31B:
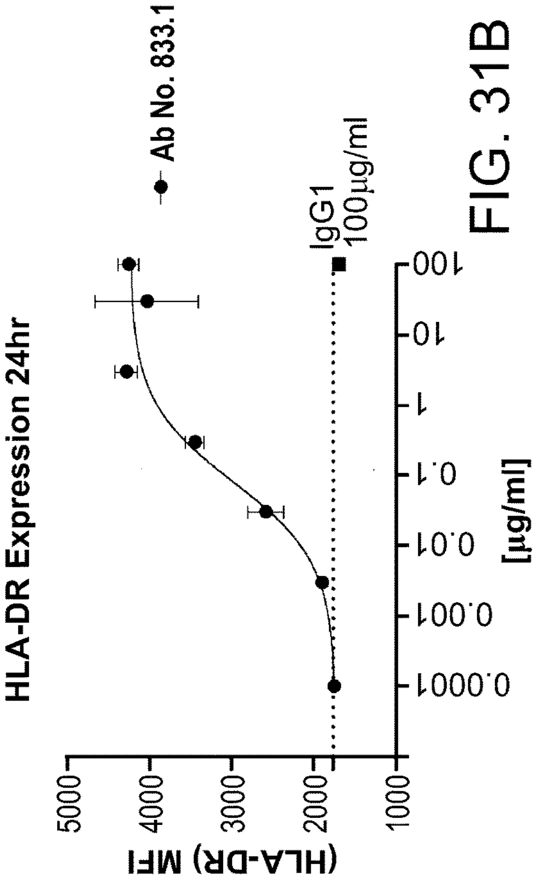
Figure 31C:
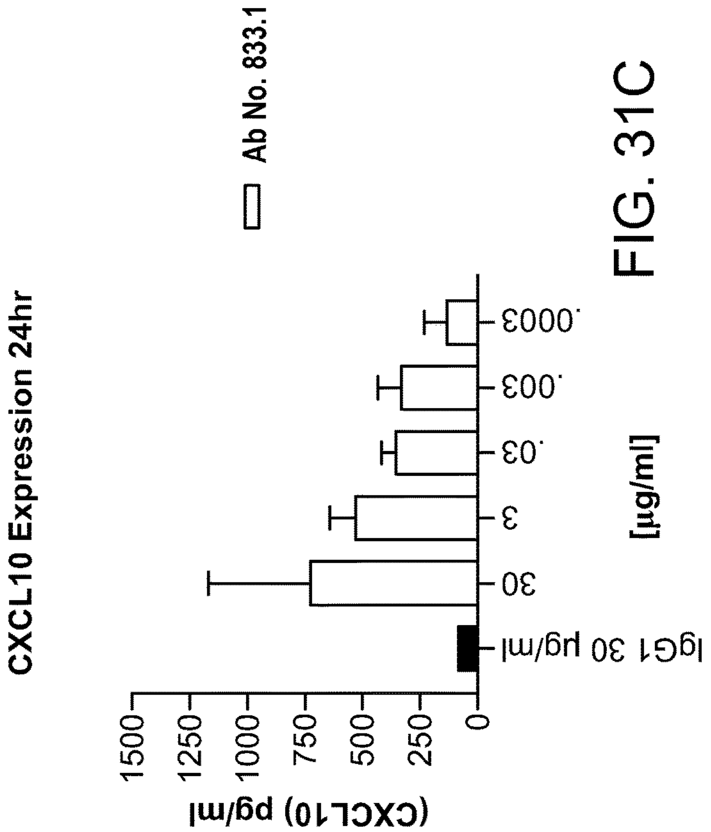
Figure 32C:
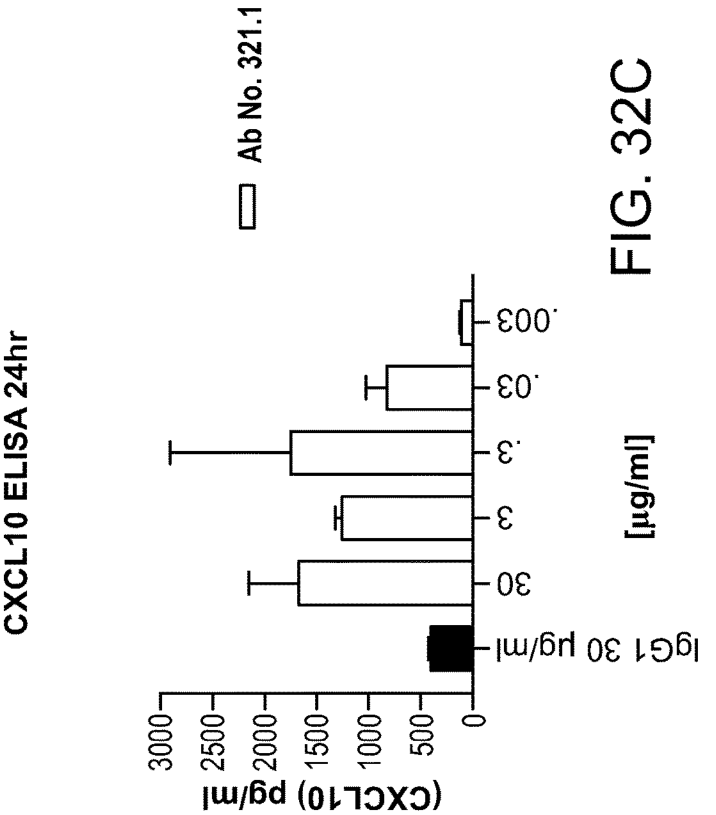
FIGS. 32A-32C. Dose-response effect of anti-VISTA antibody No. 321.1 on upregulation of activation markers HLA-DR and CD80 on CD14+ monocytes and dose-response effect of anti-VISTA antibodies on secretion of CXCL10 in co-culture at 24 hrs. $0.5\times10^5$ CD14+ enriched human PBMCs were co-cultured with $2\times10^5$ human PBMCs from the same donor in the presence of Antibody No. 321.1 or control Ab at 30, 3, 0.3, 0.03, or 0.003 μg/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-15).
Figure 32A:
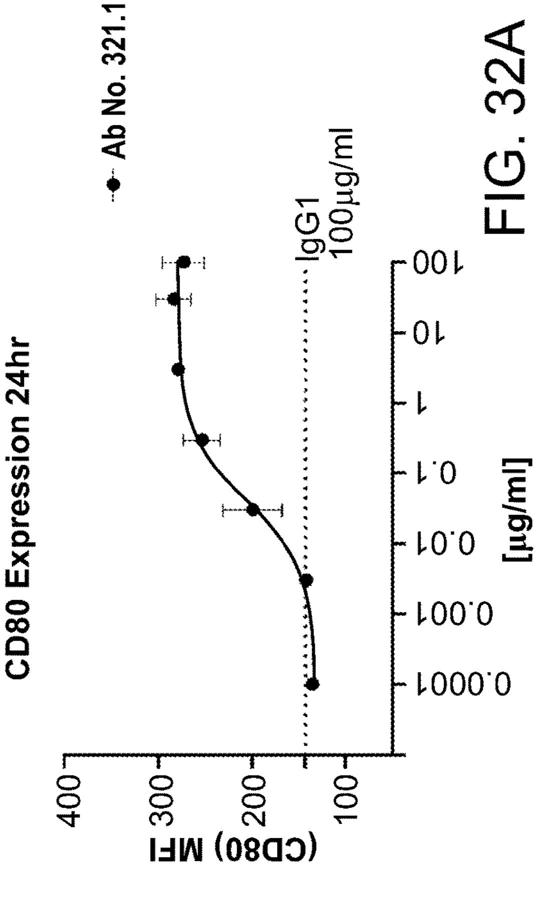
Figure 32B:
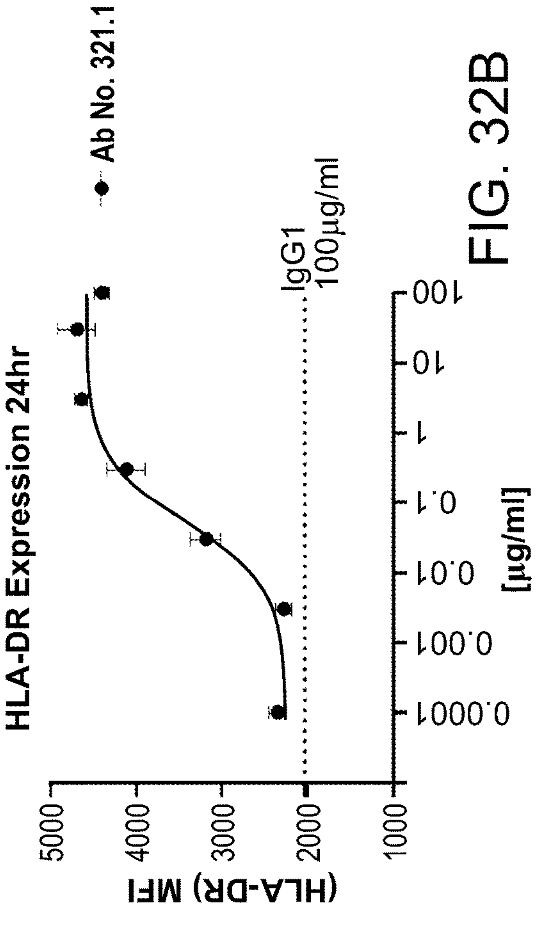
Figure 33A:
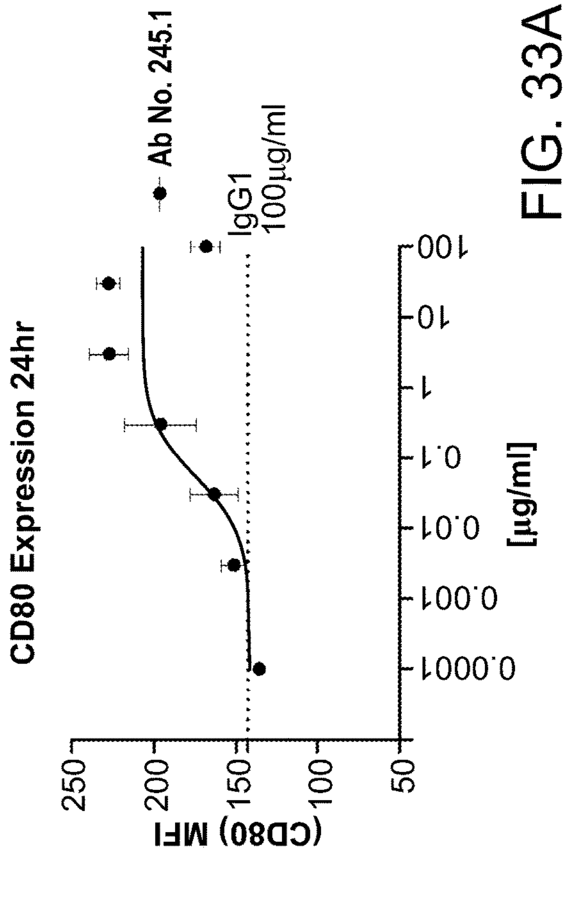
FIGS. 33A-33C. Dose-response effect of anti-VISTA antibody No. 245.1 on upregulation of activation markers HLA-DR and CD80 on CD14+ monocytes and dose-response effect of anti-VISTA antibodies on secretion of CXCL10 in co-culture at 24 hrs. 0.5×10$^5$ CD14+ enriched human PBMCs were co-cultured with 2×10$^5$ human PBMCs from the same donor in the presence of Antibody No. 245.1 or control Ab at 30, 3, 0.3, 0.03, or 0.003 μg/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-15).
Figure 33B:
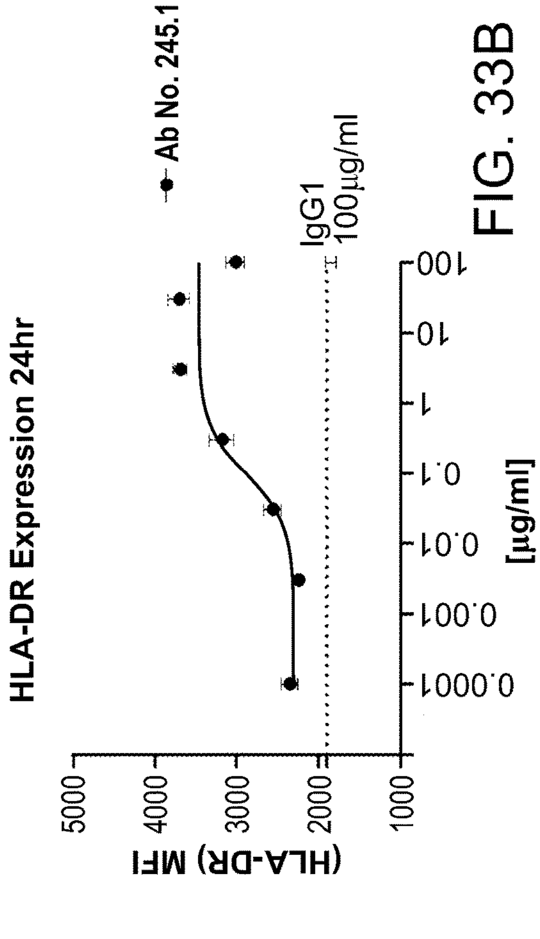
Figure 33C:
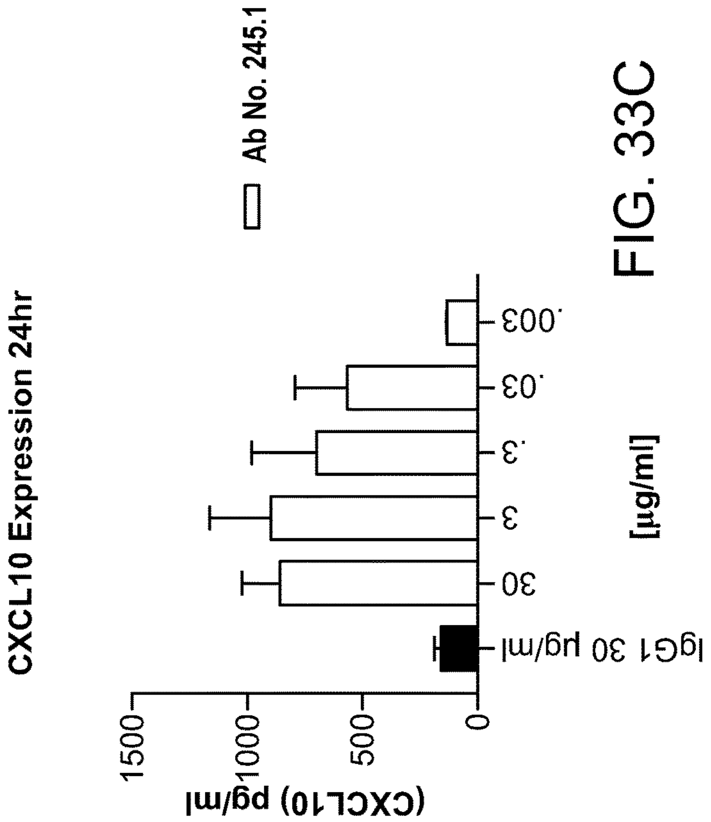
Figure 34A:
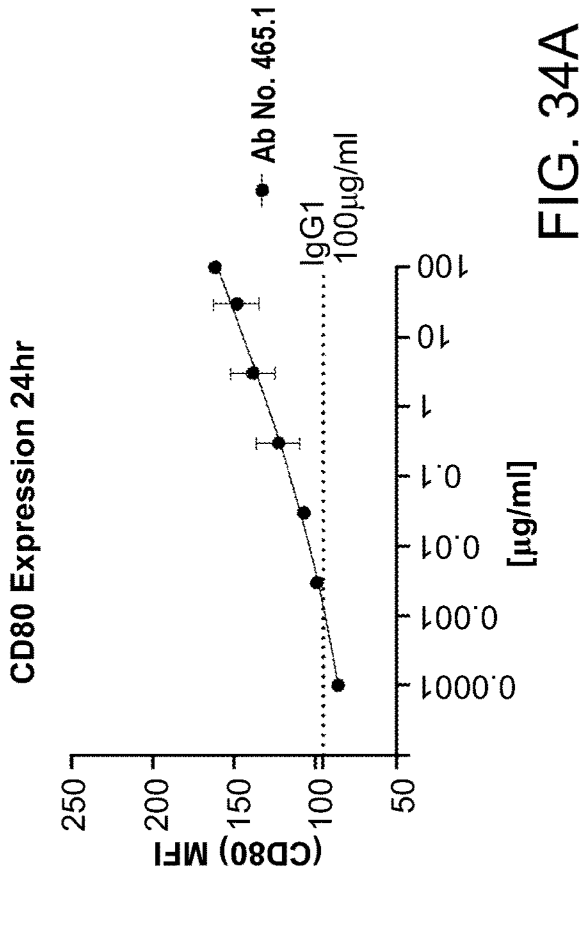
FIGS. 34A-34C. Dose-response effect of anti-VISTA antibody No. 465.1 on upregulation of activation markers HLA-DR and CD80 on CD14+ monocytes and dose-response effect of anti-VISTA antibodies on secretion of CXCL10 in culture at 24 hrs. 0.5×10$^5$ CD14+ enriched human PBMCs were co-cultured with 2×10$^5$ human PBMCs from the same donor in the presence of Antibody No. 465.1 or control Ab at 30, 3, 0.3, 0.03, or 0.003 μg/nl for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-15).
Figure 34B:
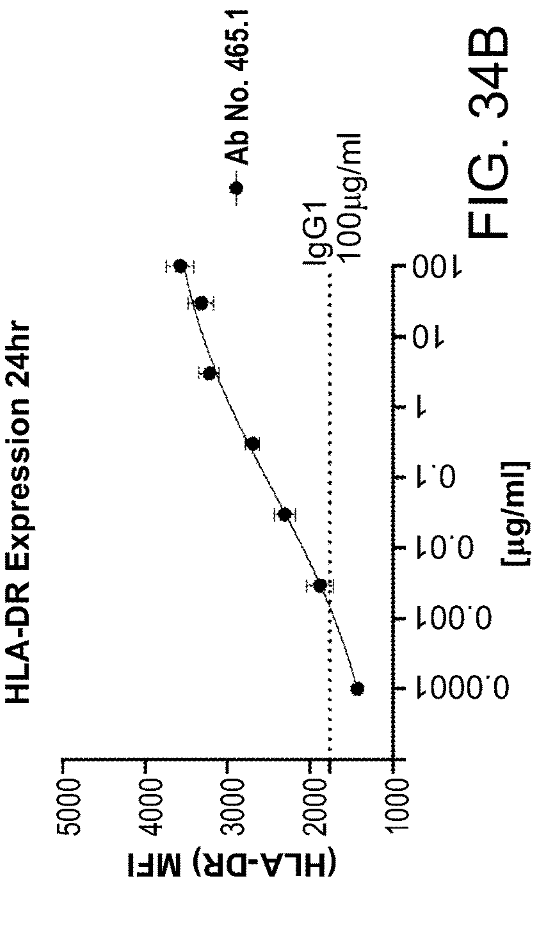
Figure 34C:
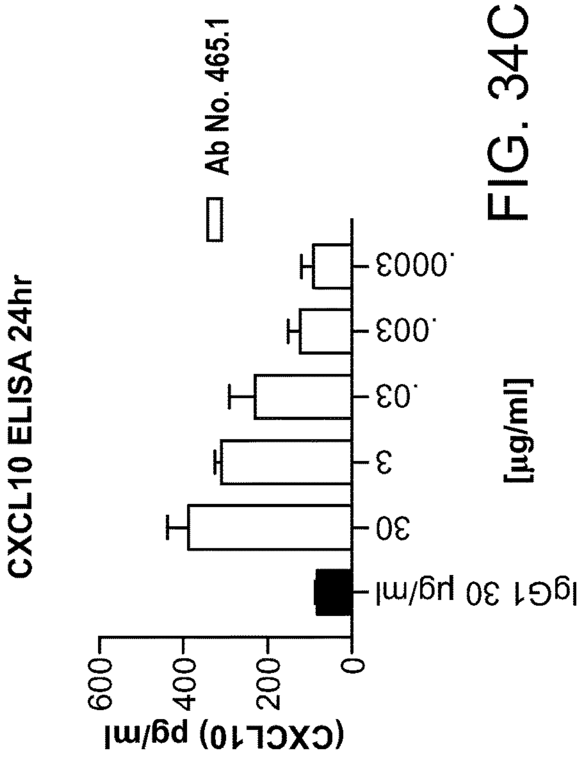
Figure 35C:
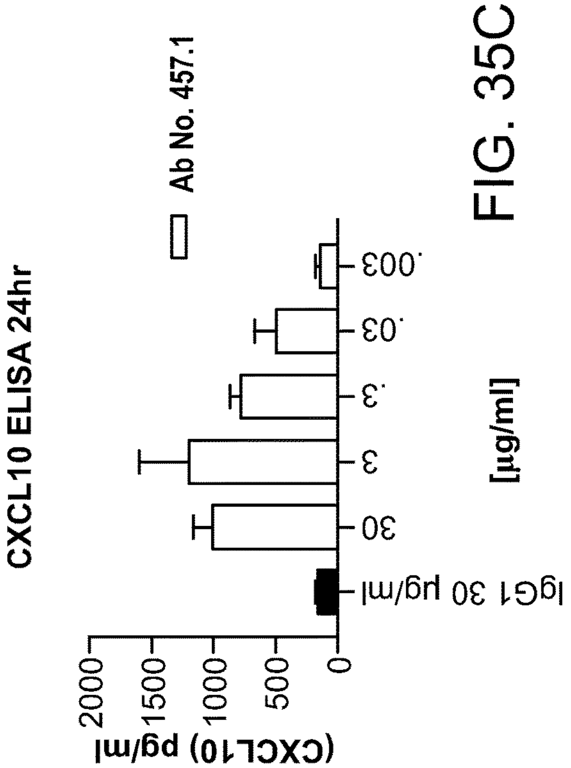
FIG. 35A-35C. Dose-response effect of anti-VISTA antibody No. 457.1 on upregulation of activation markers HLA-DR and CD80 on CD14+ monocytes and dose-response effect of anti-VISTA antibodies on secretion of CXCL10 in co-culture at 24 hrs. 0.5×10$^5$ CD14+ enriched human PBMCs were co-cultured with 2×10$^5$ human PBMCs from the same donor in the presence of Antibody No. 457.1 or control Ab at 30, 3, 0.3, 0.03, or 0.003 μg/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-15).
Figure 35A:
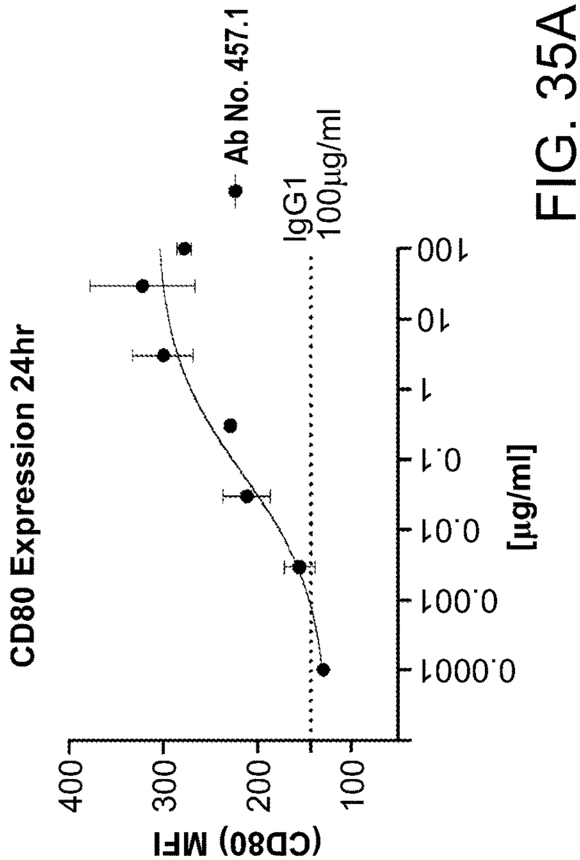
Figure 35B:
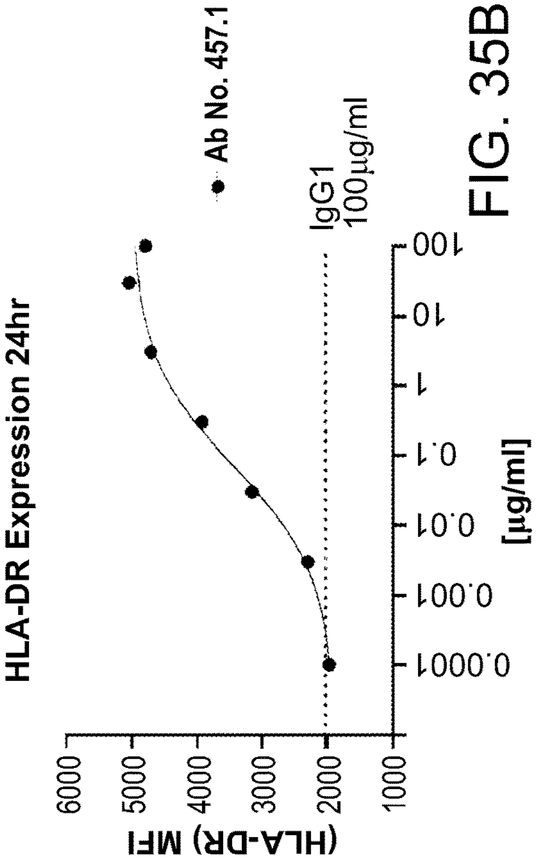
Figure 36C:
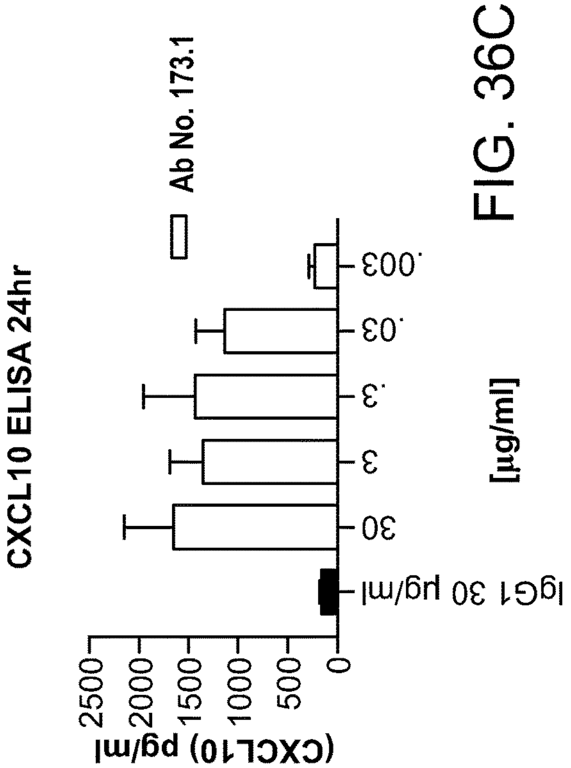
FIG. 36A-36C. Dose-response effect of anti-VISTA antibody No. 173.1 on upregulation of activation markers HLA-DR and CD80 on CD14+ monocytes and dose-response effect of anti-VISTA antibodies on secretion of CXCL10 in co-culture at 24 hrs. 0.5×10$^5$ CD14+ enriched human PBMCs were co-cultured with 2×10$^5$ human PBMCs from the same donor in the presence of antibody No. 173.1 or control Ab at 30, 3, 0.3, 0.03, or 0.003 μg/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-15).
Figure 36A:
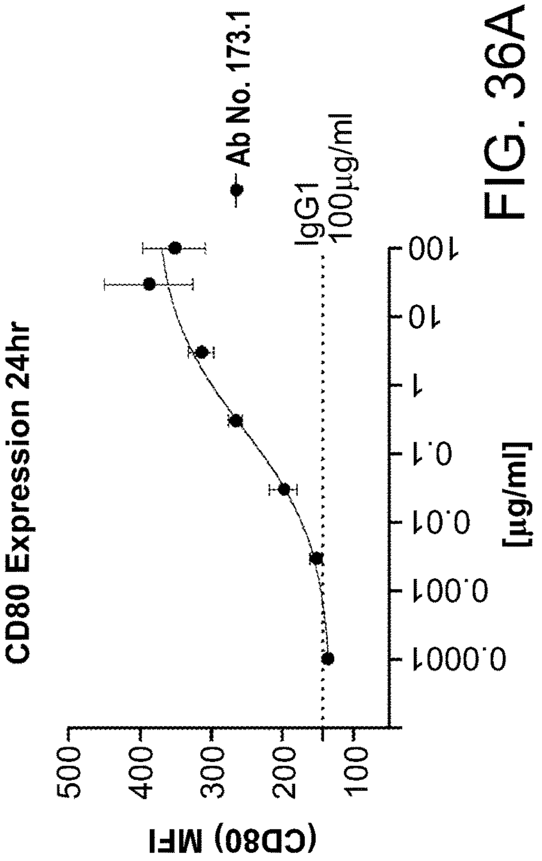
Figure 36B:
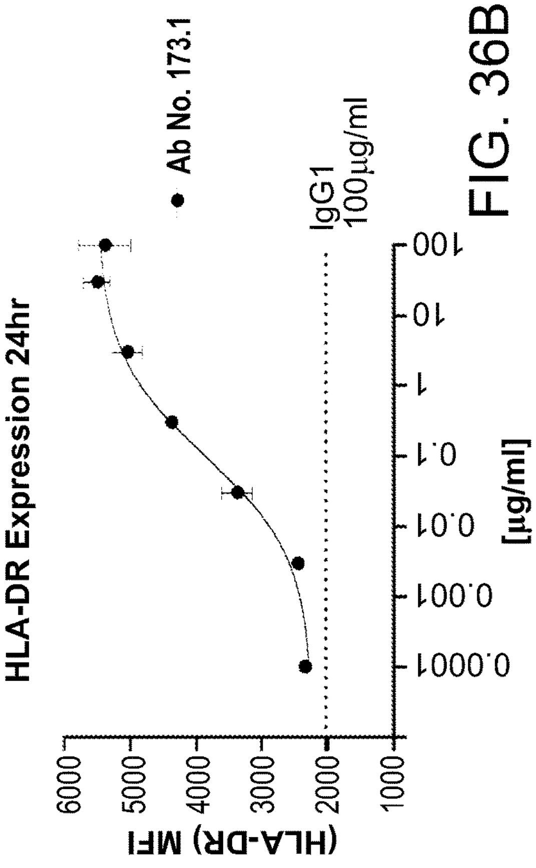
Figure 36D:
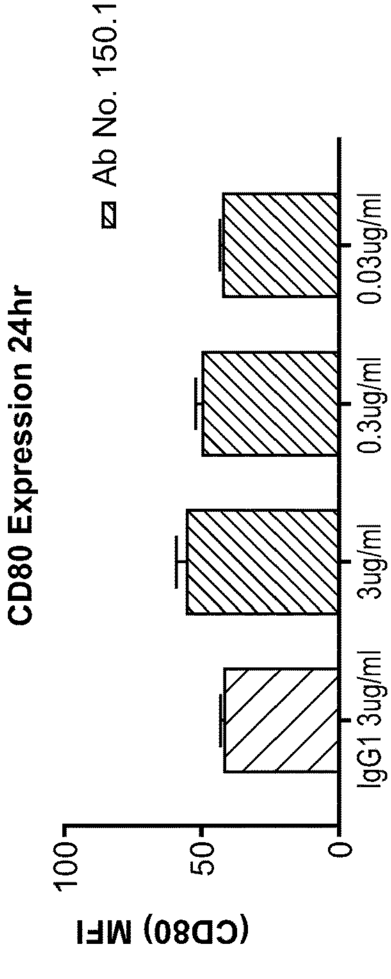
FIG. 36D-36I. Dose-response effect of Ab No. 474.1 and Ab No. 150.1 (Control is VSTB174) to induced upregulation of activation marker CD80, HLA-DR at 24 hrs on CD14+ monocytes and secretion of CXCL10. 0.5×10$^5$ CD14+ enriched human PBMCs were co-cultured with 2×10$^5$ human PBMCs in the presence of anti-VISTA Abs or isotype control Ab tested at 3, 0.3, 0.03 ug/ml for 24 hrs. Upregulation of activation marker CD80 and HLA-DR on CD14+ cells at 24 hrs was quantified by Flow Cytometry on gated CD14+ live cells. Expression of CD80 and HLA-DR on CD14+ cells was quantified by Mean Fluorescence Intensity (MFI). Secretion of CXCL10 chemokine was quantified by R&D Systems DuoSet ELISA Human CXCL10 kit (R&D Systems, Product #DY266).
Figure 36E:
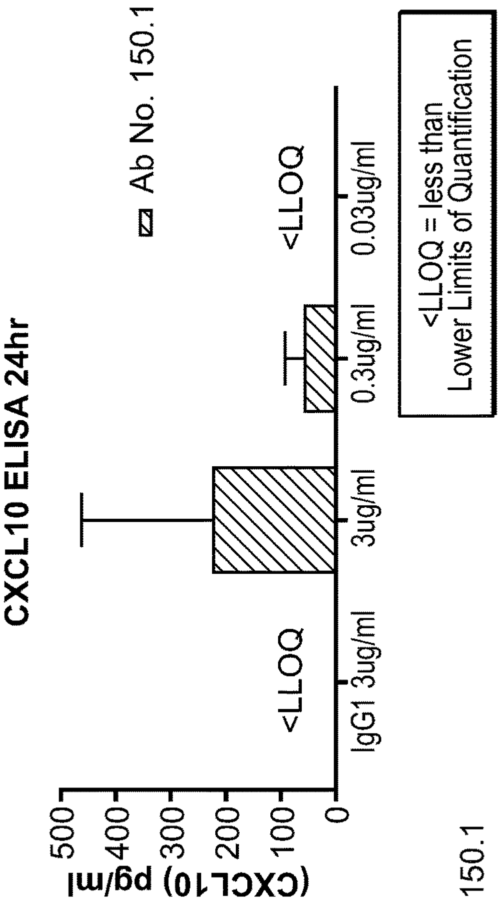
Figure 36F:
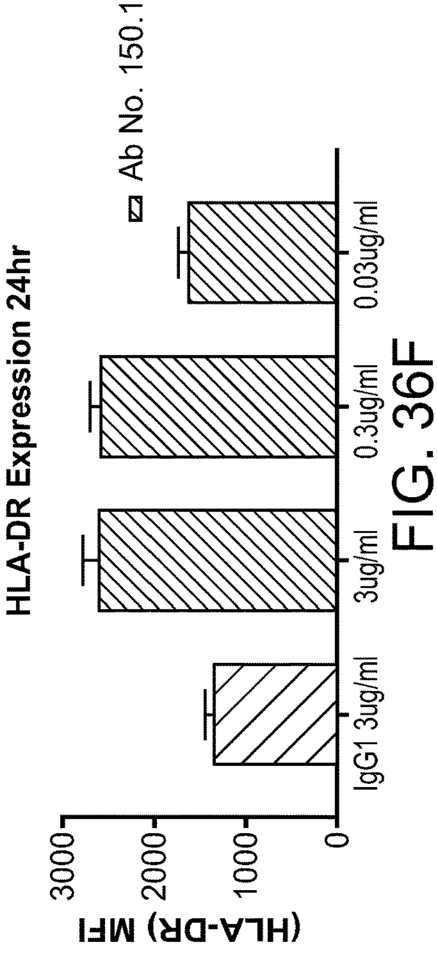
Figure 36G:
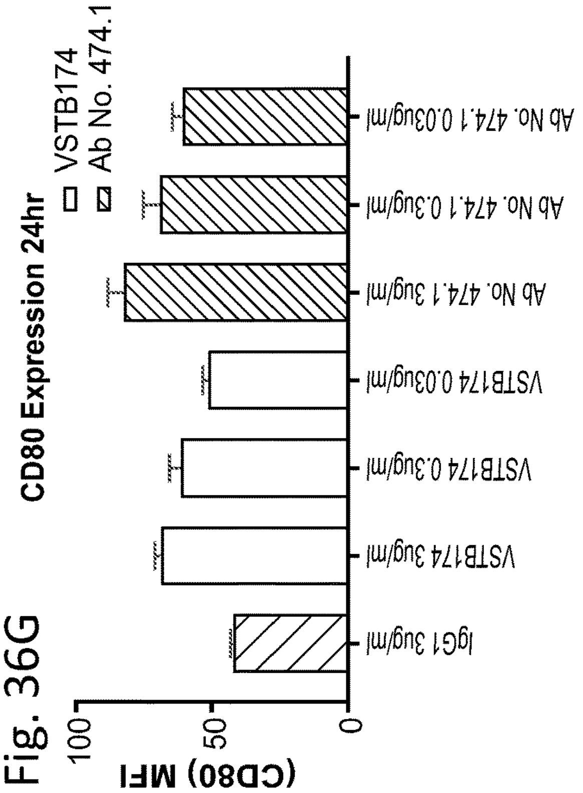
Figure 36H:
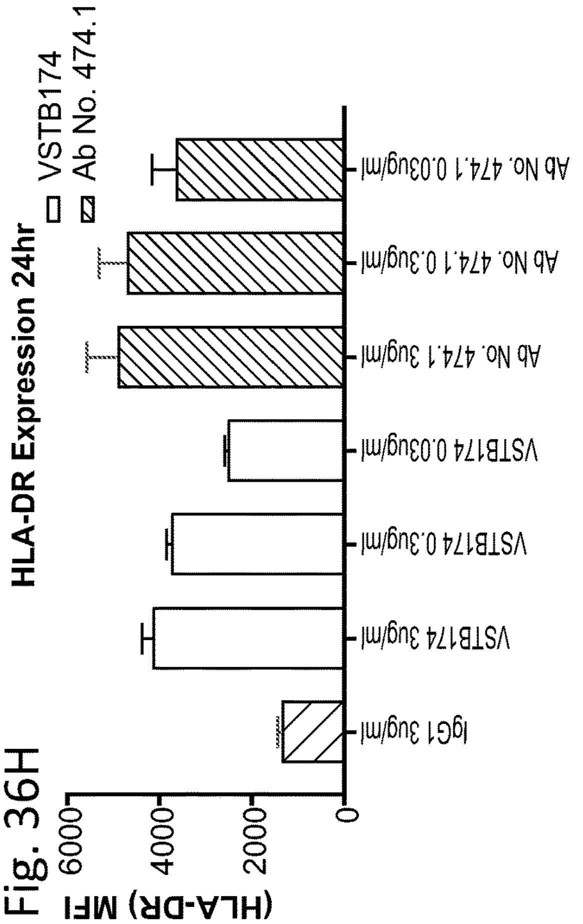
Figure 36I:
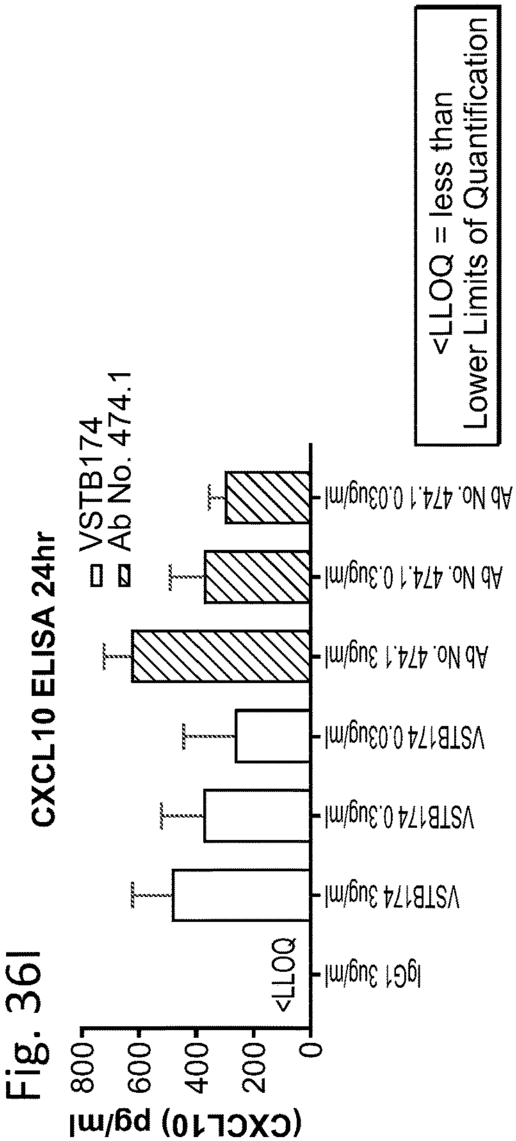

Multipoint titrations: CHO K1 cells stably expressing human VISTA on their surface were grown, harvested and labeled with anti-VISTA antibodies over a range of concentrations (0.006, 0.024, 0.098, 0.391, 1.563, 6.25, 25, and 100 nM) as described above. Data were collected and expressed as Log MFI versus Log antibody concentration. Transformed data were fit by nonlinear regression (FIGS. 8A-8R), and EC50 values were calculated as provided in the table below (Table 22).

TABLE 22

EC50 values for antibody binding to cell surface expressed human VISTA.

| Antibody | $EC_{50}$ (nM) |
|---|---|
| 269.1 | 0.1138 |
| 321.1 | 0.2667 |
| 245.1 | 0.2312 |
| 465.1 | 0.2185 |
| 457.1 | 0.118 |
| 173.1 | 0.2037 |
| VSTB174 | 0.2558 |
| 474.1 | 0.6606 |
| 150.1 | 0.06374 |
| 80 | 0.2946 |
| 92 | 0.3706 |
| 87 | 0.4584 |
| 91 | 0.8048 |
| 245.4 | 0.213 |
| 465.4 | 1.266 |
| 173.4 | 0.2467 |

Example 10: Epitope Mapping of Anti-VISTA Antibodies

Octet binning studies: Epitope mapping was performed by BLI on the Octet system. AHC sensors were used to capture anti-VISTA antibody (20 μg/mL) over 100 s. Unbound sites on the sensor were blocked with a saturating amount (50 μg/mL) of pooled purified human IgG for 180 s. Antigen (his-tagged human VISTA-ECD at 100 nM) was bound to immobilized antibody for 180 s, after which the sensor was interrogated for the ability of a paired antibody to bind the antigen in the sandwiched format. Multiple pairing arrangements were interrogated such that each antibody was used as the capture antibody in the format at least one time. Data are represented as response (nm) for the secondary antibody. Antibody VSTB-174 (described in International Patent Application Publication No. WO 2016/207717 A8) was used as a control antibody. The data reveal that each of the antibodies bind to the same epitope bin using the BLI binning technique. Data are represented in Table 23 below.

TABLE 23

| BLI response data from secondary antibody in paired binning format. | | | | | | | |
|---|---|---|---|---|---|---|---|
| Capture | Detection Ab (2nd) in Pair | | | | | | |
| Ab (1st) | 173.1 | 457.1 | 245.1 | 321.1 | 269.1 | 465.1 | VSTB-174 |
| 173.1 | 0.0434 | 0.0675 | 0.1002 | 0.0962 | 0.0651 | 0.0245 | 0.085 |
| 457.1 | 0.0278 | 0.0481 | 0.0768 | 0.0702 | 0.0507 | 0.0042 | 0.0704 |
| 245.1 | 0.0199 | 0.0427 | 0.0647 | 0.0584 | 0.0319 | 0.0022 | 0.0612 |
| 321.1 | 0.0348 | 0.0481 | 0.0701 | 0.0685 | 0.0542 | −0.005 | 0.0616 |
| 269.1 | 0.0033 | 0.0173 | 0.0365 | 0.039 | 0.066 | −0.0322 | −0.0204 |
| 465.1 | 0.0225 | 0.044 | 0.0726 | 0.0732 | 0.0505 | −0.0175 | 0.0593 |
| VSTB-174 | 0.0175 | 0.0285 | 0.0539 | 0.0432 | 0.0261 | −0.022 | 0.0372 |

Epitope mapping studies: Peptide mapping studies were used to identify linear epitopes that mediate binding of human VISTA to antibodies 245.1, 465.1, and VSTB-174. ELISA was used to measure the ability of sequential overlapping 15-mer synthetic peptides from human VISTA to block binding of an antibody to full length VISTA-ECD immobilized on a microtiter plate. Nickel coated ELISA plates were blocked with BSA and bound with 0.5 μg/mL VISTA protein (Human recombinant, produced in HEK 293 cells, SinoBiologics) for 1 h at room temperature. Anti-VISTA antibodies were diluted to 2-fold their $EC_{50}$ concentrations and pre-incubated at a 1:1 ratio with either 2 μg/mL or 20 μg/mL peptide solution in 0.5% BSA in PBST for 30 min at room temperature. Peptide-bound antibody solutions (50 μL) were added to each microtiter well and incubated for 1 h at room temperature, after which the ELISA plate was washed and processed as described above for standard ELISAs. Data are expressed as a percent reduction in ELISA signal obtained without preincubation with peptide solution. Peptides that reduced antibody binding by ≥33% were identified as potential epitopes (Table 24).

TABLE 24

| Peptide blocking studies to identify linear binding epitopes for anti-VISTA antibodies | | | | | | | | |
|---|---|---|---|---|---|---|---|---|
| | | | 245.1 | | 465.1 | | VSTB-174 | |
| Peptide Sequence | SEQ ID NO: | Spiked Peptide | 20 ug/mL peptide | 2 ug/mL peptide | 20 ug/mL peptide | 2 ug/mL peptide | 20 ug/mL peptide | 2 ug/mL peptide |
| FKVATPYSLYVCPEG | 621 | 1 | 0% | 2% | 7% | 5% | 18% | 1% |
| PYSLYVCPEGQNVTL | 622 | 2 | 9% | 1% | 1% | 0% | 3% | 8% |
| VCPEGQNVTLTCRLL | 623 | 3 | 3% | 0% | 7% | 2% | **37%** | 0% |
| QNVTLTCRLLGPVDK | 624 | 4 | 25% | 9% | 16% | 0% | 32% | 5% |
| TCRLLGPVDKGHDVT | 625 | 5 | 9% | 7% | 12% | 0% | 14% | 14% |
| GPVDKGHDVTFYKTW | 626 | 6 | 9% | 3% | 4% | 0% | 25% | 10% |
| GHDVTFYKTWYRSSR | 627 | 7 | 26% | 12% | 26% | 0% | 30% | 8% |
| FYKTWYRSSRGEVQT | 628 | 8 | 1% | 8% | 0% | 0% | **34%** | 22% |
| YRSSRGEVQTCSERR | 629 | 9 | 0% | 4% | 10% | 3% | 0% | 0% |
| GEVQTCSERRPIRNL | 630 | 10 | 0% | 0% | 4% | 0% | 0% | 2% |
| CSERRPIRNLTFQDL | 631 | 11 | 6% | 4% | 8% | 0% | 14% | 10% |
| PIRNLTFQDLHLHHG | 632 | 12 | **62%** | 20% | **55%** | 9% | **89%** | **52%** |
| TFQDLHLHHGGHQAA | 633 | 13 | **57%** | 3% | **36%** | 15% | **81%** | 26% |
| HLHHGGHQAANTSHD | 634 | 14 | **66%** | 1% | **43%** | 11% | **79%** | 20% |
| GHQAANTSHDLAQRH | 635 | 15 | 0% | 11% | 3% | 0% | **35%** | 9% |
| NTSHDLAQRHGLESA | 636 | 16 | 14% | 0% | 0% | 0% | 28% | 10% |
| LAQRHGLESASDHHG | 637 | 17 | 26% | 13% | 7% | 8% | **46%** | 21% |
| GLESASDHHGNFSIT | 638 | 18 | 3% | 3% | 4% | 0% | 32% | 17% |
| SDHHGNFSITMRNLT | 639 | 19 | 9% | 0% | 4% | 3% | 28% | 10% |

TABLE 24-continued

Peptide blocking studies to identify linear binding epitopes for anti-VISTA antibodies

| | | | 245.1 | | 465.1 | | VSTB-174 | |
|---|---|---|---|---|---|---|---|---|
| Peptide Sequence | SEQ ID NO: | Spiked Peptide | 20 ug/mL peptide | 2 ug/mL peptide | 20 ug/mL peptide | 2 ug/mL peptide | 20 ug/mL peptide | 2 ug/mL peptide |
| NFSITMRNLTLLDSG | 640 | 20 | 28% | 23% | 24% | 0% | **42%** | 20% |
| MRNLTLLDSGLYCCL | 641 | 21 | 4% | 10% | 22% | 0% | **38%** | 15% |
| LLDSGLYCCLVVEIR | 642 | 22 | **34%** | 0% | **41%** | 0% | **75%** | 18% |
| LYCCLVVEIRHHHSE | 643 | 23 | **37%** | 9% | **36%** | 2% | **67%** | 31% |
| VVEIRHHHSEHRVHG | 644 | 24 | **41%** | 8% | **43%** | 16% | **82%** | **48%** |
| HHHSEHRVHGAMELQ | 645 | 25 | **52%** | 10% | **67%** | 10% | **83%** | **45%** |
| HRVHGAMELQVQTGK | 646 | 26 | 0% | 0% | 2% | 0% | 25% | 17% |
| AMELQVQTGKDAPSN | 647 | 27 | 0% | 0% | 3% | 0% | 24% | 13% |
| VQTGKDAPSNCVVYP | 648 | 28 | 5% | 0% | 0% | 0% | 5% | 0% |
| DAPSNCVVYPSSSQE | 649 | 29 | 0% | 0% | 14% | 0% | 10% | 8% |
| CVVYPSSSQESENIT | 650 | 30 | 0% | 0% | 0% | 0% | 21% | 12% |
| SSSQESENITAA | 651 | 31 | 8% | 0% | 5% | 0% | 27% | 15% |

Two identical binding epitopes were identified by this analysis for antibodies 245.1 and 465.1 having the amino acid sequence 66HLHHG70 (amino acids 98-102 of SEQ ID NO: 380) and 116VVEIRHHHSEHR127 (amino acids 148-159 of SEQ ID NO: 380) (numbering indicates residues of human VISTA (SEQ ID NO: 380) beginning from the first amino acid of the mature polypeptide). These same peptide sequences appear to be contained within the linear epitopes identified for VSTB-174.

Mutational analysis of antibody epitope: It has been previously reported that three amino acids of human VISTA (R54, F62 and Q63) are largely responsible for binding of VSTB-112, a closely-related analog of VSTB-174, to the VISTA protein (see Mehta, N. Structure and functional binding epitope of V-domain Ig suppressor of T cell activation. *Cell Rept.* (2019) 28(10):P2509-2516). To determine if the antibodies described herein bind to an identical epitope with VSTB-174, each of these 3 amino acids was substituted with alanine in VISTA-ECD and binding of antibodies to this triple mutant protein expressed as an Fc conjugate (hVISTA ECD-Fc R54A, F62A, Q63A, SEQ ID NO: 382) was measured. ELISA was used to measure antibody binding to wild-type and mutant VISTA essentially as described above. VISTA-Fc (5 μg/mL) was immobilized on Maxisorb 96-well ELISA plates and reacted with each antibody diluted to 10 μg/mL in a standard ELISA format. Binding data were reported as absorbance at 450 nm.

VSTB-174 did not bind the triple VISTA-Fc mutant. Antibody No. 465.1 demonstrated reduced binding to mutant VISTA (~25% of wild type), suggesting a partially overlapping epitope between 465.1 and VSTB-174 (see Table 25 below). Binding of antibodies Nos. 269.1, 321.1, 245.1, 457.1, 173.1 and 833.1 was not affected by the mutations, suggesting that these antibodies bind to a different epitope from VSTB-174.

Based on the combination of antibody binning, peptide mapping and mutational analysis, it can be concluded that the tested antibodies bind to a spatially close, but distinct epitope from VSTB-174 and related antibodies.

TABLE 25

Antibody binding to mutant human VISTA-Fc

| Antibody | ELISA Abs 450 nm |
|---|---|
| 269.1 | 1.650 |
| 321.1 | 1.646 |
| 245.1 | 1.484 |
| 465.1 | 0.351 |
| 457.1 | 1.603 |
| 173.1 | 1.656 |
| 833.1 | 1.560 |
| VSTB-174 | 0.017 |
| IgG1 | 0.019 |

Mutational Analysis of Antibody Epitope by ELISA

The binding of anti-VISTA antibodies to their epitope was evaluated through various mutations of the extra cellular domain of VISTA. The numbering of the different mutations corresponds to VISTA-ECD without the signal peptide. Each mutated amino acid was substituted with alanine in VISTA-ECD and expressed as an Fc conjugated. The following antibodies No.: 474.1 (WT), 150.1 (YTE), 85, 87, 91, 92, and VSTB174 were evaluated and compared between mutant and WT VISTA ECD. ELISA was used to measure antibody binding. VISTA-Fc (3 μg/mL) was immobilized on Maxisorb 96-well ELISA plates and reacted with each antibody titrated at 100 ug/mL-0.003 ug/mL and detected using biotinylated anti-human Ig light chain kappa followed by streptavidin-HRP and TMB substrate. Binding was determined at a 450 nm optical density using a CLARIOstar plate reader. VISTA-ECD mutant (R54A, F62A and Q63A) did not bind VSTB174 and showed reduced binding to Ab No. 87 and No. 91 (Table 27, FIGS. 8S-8Y). The binding of antibodies No. 150.1, No. 474.1, No. 85 and No.

92 were not affected by this triple mutation (Tables 26-27, FIG. 8S-8Y). VISTA-ECD mutant 2.3 (Y37A, V117A, R127A) showed reduced binding to antibodies No. 150.1, No. 474.1, No. 85, No. 87, No. 91, No. 92 and VSTB174 (Tables 26-27, FIG. 8S-8Y). VSTB174 binding was the least affected by this triple mutation. Double VISTA-ECD mutant 10.1 (R54A, R127A) showed reduced binding to antibodies No. 150.1, No. 474.1, No 85, No. 87, No. 91, No. 92 and VSTB174 (Tables 26-27, FIG. 8S-8Y). VSTB174 binding was the least affected by this double mutation.

It has been previously reported that three amino acids of human VISTA (R54, F62 and Q63) are largely responsible for binding of VSTB-112, a closely-related analog of VSTB-174, to the VISTA protein (see Mehta, N. Structure and functional binding epitope of V-domain Ig suppressor of T cell activation. Cell Rept. (2019) 28(10): P2509-2516). Binding of antibodies No. 150.1, No. 474.1, No. 85 and No. 92 were not affected suggesting these antibodies bind to a separate epitope reported for VSTB-174. These data all together indicate that Ab No. 150.1 and Ab No. 474.1 bind to a different epitope than VSTB174 and the key amino acids in this epitope recognized by Ab No. 150.1 and Ab No. 474.1 are, Tyrosine 37, Arginine 54, Valine 117 and Arginine 127 of SEQ ID NO:377.

TABLE 26

Antibody binding to mutant human VISTA-Fc

| Mutant Name | Mutations | Ab No. 474.1 ELISA $EC_{50}$ (μg/mL) | Ab No. 150.1 ELISA $EC_{50}$ (μg/mL) | VSTB174 $EC_{50}$ (μg/mL) | IgG1 ELISA $EC_{50}$ (μg/mL) |
|---|---|---|---|---|---|
| WT-VISTA-ECD-Fc | None | 0.12 | 0.15 | 0.06 | >100 |
| RFQ-VISTA-ECD-Fc | R54A, F62A, Q63A | 0.14 | 0.12 | >100 | >100 |
| 8xHis-Ala-VISTA-ECD-Fc | H66A, H68A, H72A, H93A, H94A, H121A, H122A, and H123A | 0.14* | N/D | 0.08 | >100 |
| 3xHis-Ala-VISTA-ECD-Fc | H121A, H122A, and H123A | 0.16* | N/D | 0.1 | >100 |
| 2xHis-Ala-VISTA-ECD-Fc | H66A, H68A | 0.15* | N/D | 0.1 | >100 |
| 1.1-VISTA-ECD-Fc | N59A, T61A, D64A | 0.47 | N/D | 0.1 | >100 |
| 1.2-VISTA-ECD-Fc | H79A, D80A, L81A | 0.20 | N/D | 0.1 | >100 |
| 1.3-VISTA-ECD-Fc | Q83A, R84A, H85A | 0.20 | N/D | 0.1 | >100 |
| 2.1-VISTA-ECD-Fc | T35A, I119A, S124A | 0.20 | N/D | >100 | >100 |
| 2.1A-VISTA-ECD-Fc | T35A | 0.24 | N/D | 0.1 | >100 |
| 2.1B-VISTA-ECD-Fc | I119A | 0.2 | N/D | 0.07 | >100 |
| 2.1C-VISTA-ECD-Fc | S124A | 0.19 | N/D | 0.07 | >100 |
| 2.1D-VISTA-ECD-Fc | T35A, I119A | 0.18 | N/D | 0.05 | >100 |
| 2.1E-VISTA-ECD-Fc | I119A, S124A | 0.19 | N/D | 74 | >100 |
| 2.1F-VISTA-ECD-Fc | T35A, S124A | 0.20 | N/D | 0.09 | >100 |
| 2.2-VISTA-ECD-Fc | L115A, H129A | 0.19 | N/D | 0.1 | >100 |
| 2.3-VISTA-ECD-Fc | Y37A, V117A, R127A | 56.0 | >100 | 21 | >100 |
| 2.3A-VISTA-ECD-Fc | Y37A | 0.19 | N/D | 0.06 | >100 |
| 2.3B-VISTA-ECD-Fc | V117A | 0.17 | N/D | 0.09 | >100 |
| 2.3C-VISTA-ECD-Fc | R127A | 0.10 | N/D | 0.07 | >100 |
| 2.3D-VISTA-ECD-Fc | Y37A, V117A | 0.19 | N/D | 0.04 | >100 |
| 2.3E-VISTA-ECD-Fc | V117A, R127A | 0.11 | N/D | 0.08 | >100 |
| 2.3F-VISTA-ECD-Fc | Y37A, R127A | 0.14 | N/D | 0.06 | >100 |
| 3.1-VISTA-ECD-Fc | E47A, V48A, Q49A | 0.20 | N/D | 0.1 | >100 |
| 3.2-VISTA-ECD-Fc | S52A, E53A, R55A | 0.22 | N/D | 0.1 | >100 |
| 4.1-VISTA-ECD-Fc | Q73A, N76A | 0.19 | N/D | 0.1 | >100 |
| 5.1-VISTA-ECD-Fc | H32A, D33A, T35A | 0.17 | N/D | 0.1 | >100 |
| 6.1-VISTA-ECD-Fc | E14A, L106A, L107A | 0.19 | N/D | 0.1 | >100 |
| 5xN-VISTA-ECD-Fc | N17Q, N59Q, N76Q, N96Q, N158Q | 0.19 | 0.18 | 0.1 | >100 |
| 3xN-VISTA-ECD-Fc | N59Q, N76Q, N158Q | 0.20 | 0.2 | 0.1 | >100 |
| 2xN-VISTA-ECD-Fc | N17Q, N96Q | 0.19 | 0.21 | 0.1 | >100 |
| 7.1-VISTA-ECD-Fc | F36A | 0.28 | N/D | 0.08 | >100 |
| 7.2-VISTA-ECD-Fc | K38A | 0.28 | N/D | 0.09 | >100 |
| 7.3-VISTA-ECD-Fc | T39A | 0.21 | N/D | 0.11 | >100 |
| 7.4-VISTA-ECD-Fc | E125A | 0.14 | N/D | 0.08 | >100 |
| 8.1-VISTA-ECD-Fc | H122A | 0.18 | 0.30 | 0.06 | >100 |
| 10.1-VISTA-ECD-Fc | R54A, R127A | >100 | >100 | >100 | >100 |
| 10.2-VISTA-ECD-Fc | F62A, R127A | 0.11 | 0.10 | 0.05 | >100 |
| 10.3-VISTA-ECD-Fc | Q63A, R127A | 0.11 | 0.20 | 0.04 | >100 |

TABLE 27

| Antibody binding to mutant human VISTA-Fc | | | | | |
|---|---|---|---|---|---|
| Mutant Name | Mutations | Ab No. 85 ELISA $EC_{50}$ (μg/mL) | Ab No. 87 ELISA $EC_{50}$ (μg/mL) | Ab No. 91 ELISA $EC_{50}$ (μg/mL) | Ab No. 92 ELISA $EC_{50}$ (μg/mL) |
| RFQ-VISTA-ECD-Fc | R54A, F62A, Q63A | 0.33 | 32 | 1.3 | 0.13 |
| 2.3-VISTA-ECD-Fc | Y37A, V117A, R127A | >100 | >100 | >100 | 94 |
| 5xN-VISTA-ECD-Fc | N17Q, N59Q, N76Q, N96Q, N158Q | 0.14 | 0.13 | 0.15 | 0.19 |
| 3xN-VISTA-ECD-Fc | N59Q, N76Q, N158Q | 0.18 | 0.14 | 0.20 | 0.21 |
| 2xN-VISTA-ECD-Fc | N17Q, N96Q | 0.20 | 0.18 | 0.20 | 0.21 |
| 8.1-VISTA-ECD-Fc | H122A | 0.2 | 0.14 | 0.19 | 0.15 |
| 10.1-VISTA-ECD-Fc | R54A, R127A | >100 | >100 | >100 | >100 |
| 10.2-VISTA-ECD-Fc | F62A, R127A | 8.1 | >100 | 0.16 | 0.10 |
| 10.3-VISTA-ECD-Fc | Q63A, R127A | 0.10 | 86 | 0.10 | 0.10 |

Example 11: In Vitro Functional Characterization of Anti-VISTA Mab in a *Staphylococcus* EnterotoxinB (SEB) Human T Cell Activation Assay The efficacy of anti-VISTA mAbs (all IgG1 and some IgG4) was evaluated in the SEB human T cell activation assay. Briefly, in the SEB assay, human PBMCs from a single healthy donor are incubated with a bacterial super-antigen (SEB at 5 ng/ml), which directly links MVHC class II protein on the surface of antigen-presenting cells (APC) to the T cell receptor (TCR) on T cells, causing T cell activation, and subsequently IFNγ cytokine secretion, which is quantitatively measured after 4 days. Since IFNγ can also be secreted by NK cells, NK cell depleted PBMCs were used in the assay to reduce background signal and improve the dynamic range of the response. Isotype IgG1 or IgG4 mAb were used as negative controls in the respective assays. mAbs were screened at a saturating concentration of 3 μg/ml.

PBMCs from a healthy donor were thawed in a 37° C. water bath. Cells were pelleted at 1500 rpm for 5 min at room temperature and washed in Cell Culture Media before counting. Cells were then resuspended at 1E8 cells/ml in EasySep Media and transferred to a 5 ml polystyrene round-bottom tube. NK cell depletion was performed as followed using the EasySep NK selection kit. A selection Cocktail (100 μl/ml of sample (cells)) was added, mixed and incubated for 6 min at room temperature before adding RapidSpheres (100 μl/ml of sample (cells)). This mix was incubated for 6 min at room temperature before completing to 2.5 ml final volume with EasySep Media. Then, the tube was placed without lid into the magnet and incubated for 6 min at room temperature. The tube was inverted with the magnet and the supernatant discarded into a new tube. This supernatant was placed back into the magnet and incubate for 6 min at room temperature. The tube with the magnet was then inverted and the discarded supernatant was collected into a new 15 ml polypropylene conical tube. This corresponds to the NK-depleted PBMCs subset completed to a final volume of 12 ml with Cell Culture Media. Cells were centrifuged at 1500 rpm for 5 min at room temperature and the pellet resuspended in a 5 ml Cell Culture Media before counting. Finally, cells were resuspended at 2E6 cells/ml in Cell Culture Media-ready for SEB activation assay. For this, 100 μl of cells were added per well ($2\times10^5$ cells/well) to a 96-well U-bottom tissue culture plate (Corning cat #3799) and conditions were performed in triplicates. Fifty 1 of Cell Culture Media containing the test Abs at a concentration of 12 μg/mL (4×) were added for a final test Ab concentration of 3 μg/mL. For the dose titration of the tested Abs, the following final concentrations were prepared and incubated 20 min at room temperature: 30, 3, 0.3, 0.03 μg/ml. Then, 50 μL of Cell Culture Media containing the SEB antigen at a concentration of 20 ng/mL (4×) for a final SEB concentration of 5 ng/mL was added per well before a 4 days incubation at 37° C. and 5% $CO_2$. Supernatants were then collected after centrifugation at 1500 rpm for 5 min at room temperature and analyzed for IFNγ production using Pro-Quantum (ThermoFischer cat #A355765) or ELISA Kit (Invitrogen cat #88-7316-88), according to the manufacturer's instructions.

In conclusion, Ab No. 269.1, Ab No. 321.1, Ab No. 245.1, Ab No. 474.1, Ab No. 150.1, Ab No. 465.1, Ab No. 457.1, Ab No. 173.1, and Ab No. 833.1 demonstrate efficacy in the SEB-induced human T cell activation assay and potentiate human T cell activation in a dose-dependent manner. IgG1 Fc backbone is more efficacious than IgG4 Fc backbone in the SEB-induced human T cell activation assay (FIGS. 9-17).

Example 12: In Vitro Functional Characterization of Anti-VISTA Mab in a T Cell Activation Assay In this assay, the ability of anti-VISTA antibodies to restore T cell proliferation in VISTA treated cells was evaluated by flow cytometry and T cell activation by measuring IFNγ secretion using ELISA. [00497]96-well flat-bottom plate(s) were coated with the appropriate anti-CD3 solution, Isotype Ab, or anti-VISTA antibody solution at 100 μl/well of a 96-well flat-bottom plate and incubated at 4° C., overnight. CD3+ pan T cells were thawed at 37° C., in warm X-VIVO15 medium supplemented with CTL Anti-Aggregate Wash and counted. Cells were pelleted at 400 g for 5 min and resuspended at $1\times10^6$ cells/ml in PBS for CellTrace labelling. To label the cells with CellTrace, 1 μl of 5 mM Violet per ml sample (final concentration 5 μM CellTrace Violet) was added to the cells, and the cells were incubated 20 min at 37° C., in the dark. To quench the staining, 5 volumes of 10% FBS/media was added and the cells were incubated for 5 min at 20° C. Then, the cells were pelleted at 400 g, 5 min at 20° C. and resuspended at $2\times10^6$ cells/ml in X-VIVO15 medium.

The plates coated with anti-CD3 Ab were washed with PBS twice, and VISTA coated beads were added in the presence or absence of Abs (100 μg/ml) before further adding 100 μl/well (i.e., $2\times10^5$ cells/well) of T cells. Plates were then incubated at 37° C. in 5% $CO_2$ for 4 days. The supernatant was then collected for IFNγ immunoassays and the cells, after centrifugations and washes, were recovered for flow cytometry analysis.

Antibody No.173.1 demonstrated reversal of VISTA-mediated suppression of human pan T cell activation induced by an anti-CD3 antibody. This reversal of VISTA-mediated suppression of T cell activation by the antibody was observed when human pan T cells were stimulated with plate-bound anti-CD3 Ab, and VISTA suppression was mediated by VISTA-coated beads (but not when the VISTA was plate-bound). Antibody No. 269.1, antibody No. 321.1 and antibody No. 457.1 demonstrated reversal of VISTA-mediated suppression of anti-CD3 human pan T cell activation. Antibody No. 245.1 demonstrated modest reversal of VISTA-mediated suppression of anti-CD3 human pan T cell activation (FIGS. 18A-22B).

Example 13: In Vitro Functional Characterization of Anti-VISTA Antibodies in a Monocyte Activation Assay The functional activity of antibodies in inducing human monocyte activation was determined using a monocyte activation functional assay. Briefly, PBMCs from a single donor were enriched for CD14+ monocyte population from the same donor and then incubated for 24 hrs with anti-VISTA mAbs, causing monocyte activation, upregulation of cell surface activation markers HLA-DR, CD80 and CD86 on CD14+ monocytes, as well as CXCL10 chemokine secretion. A functional screen of some of the anti-VISTA mAbs described herein was performed at a single dose and in a dose-dependent manner. The role of an IgG1 versus IgG4 Fc backbone, as well as the role of NK cells, was also evaluated in this assay.

CD14+ cells enrichment: PBMCs from healthy donors were thawed and cells pelleted by centrifugation at 1500 rpm for 5 min, at room temperature. After a wash with 10 ml Cell Culture Media, cells were counted and resuspended in 300 ml MACS Buffer for CD14+ enrichment. Hundred μl FcR Blocking Reagent was added first, before the addition of 100 ml Biotin-Antibody Cocktail, then mixed gently and incubated for 10 min on ice in the dark. Two hundred μl of Anti-Biotin MicroBeads were then added, mixed gently, and incubated for 15 min at room temperature. After washing the cells with MACS Buffer, they were centrifuged at 1500 rpm for 5 min at room temperature and resuspended in 500 μl of MACS Buffer before being placed on a LS column in the magnetic field of a suitable MACS Separator. Cells eluted after a pass-through were collected in a 15 ml polypropylene conical tube. The column was further washed 3 times with MACS Buffer and the eluate collected before centrifugation at 1500 rpm for 5 min at room temperature. The resulting cell pellet was resuspended in 5 ml cell culture media, counted, and approximately 2×106 cells were saved for post-enrichment staining, while 10×106 cells were kept for unlabeled co-culture plates. These enriched CD14+ cells were resuspended at 1×106 cells/ml in PBS and labelled with CellTrace Violet. One μl of 5 mM Violet per ml sample (final concentration: 5 μM CellTrace Violet) was added, and cells were incubated for 20 min at 37° C. in the dark. To quench the staining, 5 volumes of medium containing 10% FBS were added and incubated for 5 min before cell centrifugation at 400 g for 5 min at room temperature. Cells were then resuspended at 1×10^6 cells/ml in cell culture media.

PBMCs preparation: PBMCs from the same donor were thawed and cells pelleted after centrifugation at 1500 rpm for 5 min at room temperature. After a wash with 10 ml cell culture media, cells were counted and resuspended at 4×106 cells/ml in cell culture media.

Fifty μl/well of CD14+ cells (0.5×105 cells/well) were added to 50 μl/well of human PBMCs (2×105 cells/well) and placed in a 96-well plate in the incubator while preparing the antibodies. Test antibodies were diluted at 2× final concentration, and added in the 96-well plate for 24 hrs at 37° C. and 5% CO2. One plate with CellTrace Violet-labeled CD14+ enriched cells were set aside and used for flow cytometry analysis, and the second plate (same layout) with unlabeled cells was used for measurements of CXCL-10 secretion. For CXCL10 secretion, cells were pelleted at 1500 rpm for 5 min at room temperature and the supernatant transferred to a 96-well plate to perform a CXCL10 ELISA according to manufacturer's protocol.

For flow cytometry analysis, 50 μl of anti-FcR antibody (huIgG at 100 μg/ml final in FACS Buffer) was added per well and incubated on ice for 15 min. Then, for extracellular staining, 50 μl Ab Mix/well (containing antibodies against CD14, CD80, CD86, HLA-DR, and Live/Dead stain) was added and incubated on ice for 15 min in the dark before centrifugations and washes at 1000 g, 4C for 2 min. Cells were analyzed in an AttunNext flow cytometer.

For experimental readouts, upregulation of activation markers CD80, CD86, and HLA-DR on CD14+ cells were analyzed by flow cytometry at 24 hrs and CXCL10 secretion was analyzed by ELISA at 24 hrs.

Antibody No.269.1, antibody No. 321.1, antibody No. 245.1, antibody No. 150.1, antibody No. 474.1, antibody No. 465.1, antibody No. 457.1, antibody No. 173.1 and antibody No. 833.1 were selected based on their efficacy in the initial screen and were further characterized in dose-response experiments, ranging from 100 μg/ml to 0.003 μg/ml of tested anti-VISTA antibody.

Antibody No.269.1, antibody No. 321.1, antibody No. 245.1, antibody No. 465.1, antibody No. 457.1, antibody No. 173.1, antibody No. 150.1, antibody No. 474.1 and antibody No. 833.1 demonstrated efficacy in the human monocyte activation assay in a dose-dependent manner (FIGS. 23A-23D, 24A-24C, 25A-25D, 26A-26C, 27A-27C, 28A-28D, 29A-29-D, 30A-30C, 31A-31C, 32A-32C, 33A-33C, 34A-34C, 35A-35C, 36A-36I).

To evaluate the role of the Fc domain of the selected mAbs in mediating efficacy in the Monocyte activation assay, antibody No. 245.1, antibody No. 465.1, antibody No. 474.1 and antibody No. 173.1 (IgG1 backbone) were tested alongside their IgG4 backbone counterparts (antibody No. 245.4, antibody No. 465.4, antibody No. 246.4 and antibody No. 173.4, respectively) in the monocyte activation assay using the same protocol as described above.

Figure 37C:
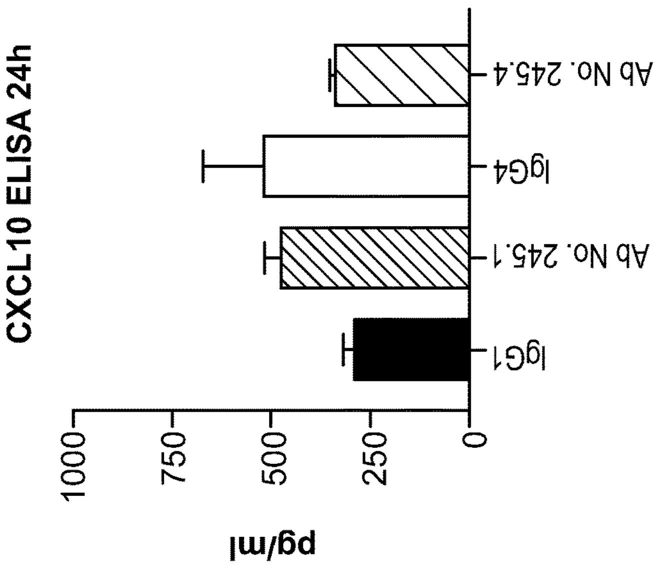
FIG. 37A-37C. Effect of anti-VISTA antibodies on upregulation of activation markers CD80 and HLA-DR on CD14+ monocytes, and effect of anti-VISTA antibodies on secretion of CXCL10 in co-culture at 24 hrs. 0.5×10$^5$ CD14+ enriched human PBMCs were co-cultured with 2×10$^5$ human PBMCs from the same donor in the presence of antibody No. 245.1 and antibody No. 245.4 or control Abs at 10 g/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-05). Antibodies tested are shown on the x-axis.
Figure 37B:
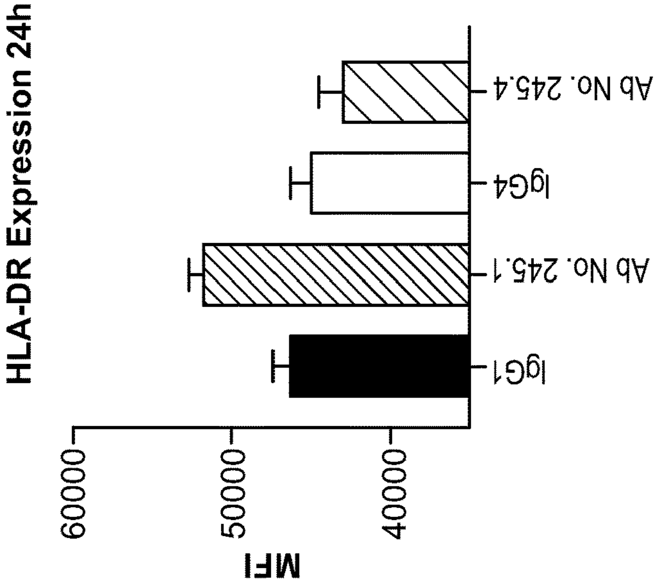
Figure 37A:
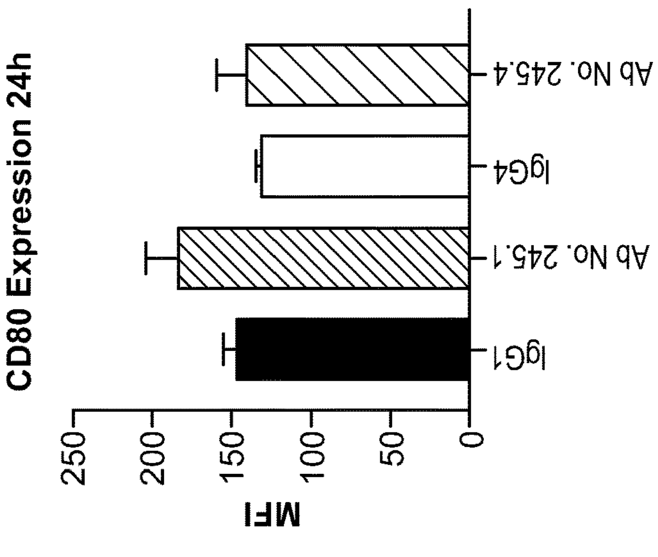
Figure 37E:
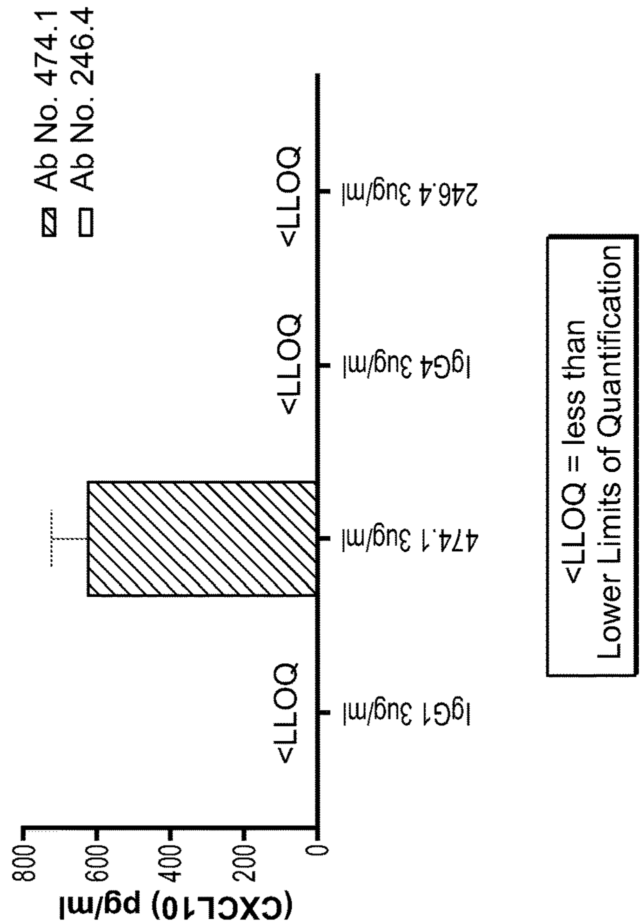
FIG. 37D-37F. Effect of Ab NO. 474.1 and Ab No. 246.4 its IgG4 counterpart to induced upregulation of activation marker CD80, HLA-DR at 24 hs on CD14+ monocytes and secretion of CXCL10. 0.5×10$^5$ CD14+ enriched human PBMCs were co-cultured with 2×10$^5$ human PBMCs in the presence of anti-VISTA Abs or isotype controls Abs at 3 ug/ml for 24 hrs. Upregulation of activation marker CD80 and HLA-DR on CD14+ cells at 24 hrs was quantified by Flow Cytometry on gated CD14+ live cells. Expression of CD80 and HLA-DR on CD14+ cells was quantified by Mean Fluorescence Intensity (MFI). Secretion of CXCL10 chemokine was quantified by R&D Systems DuoSet ELISA Human CXCL10 kit (R&D Systems, Product #DY266).
Figure 37D:
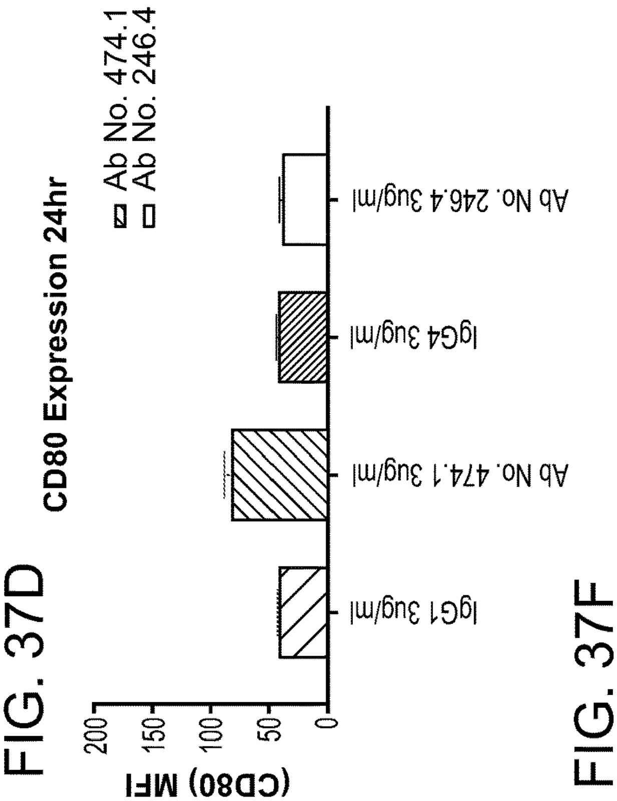
Figure 37F:
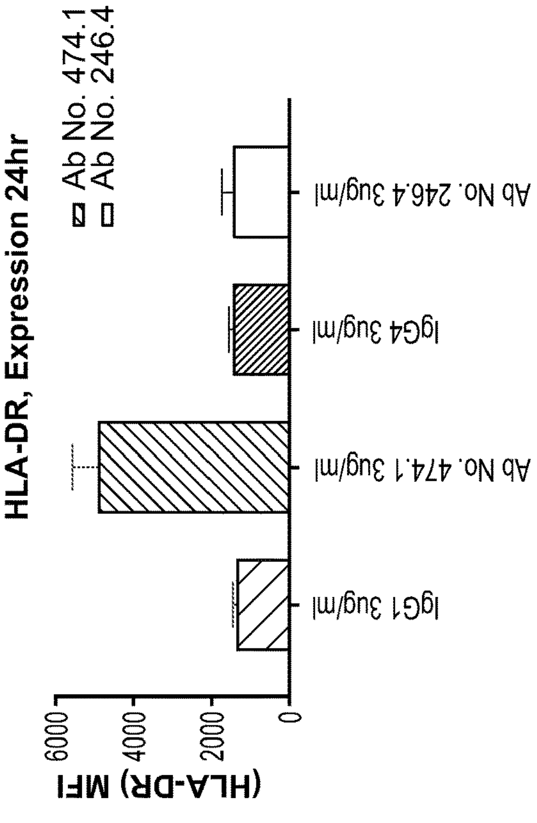
Figure 38A:
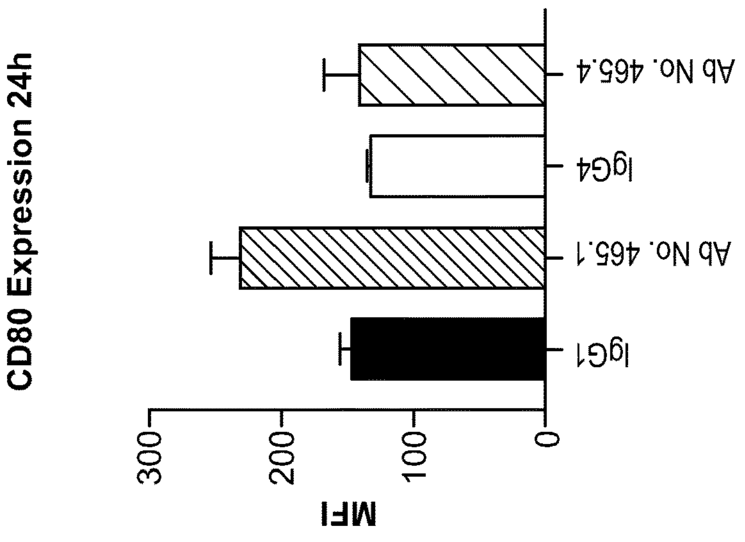
FIG. 38A-38C. Effect of anti-VISTA antibodies on upregulation of activation markers CD80 and HLA-DR on CD14+ monocytes, and effect of anti-VISTA antibodies on secretion of CXCL10 in co-culture at 24 hrs. 0.5×10$^5$ CD14+ enriched human PBMCs were co-cultured with 2×10$^5$ human PBMCs from the same donor in the presence of antibody No. 465.1 and antibody No. 465.4 or control Abs at 10 μg/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-05). Antibodies tested are shown on the x-axis.
Figure 38B:
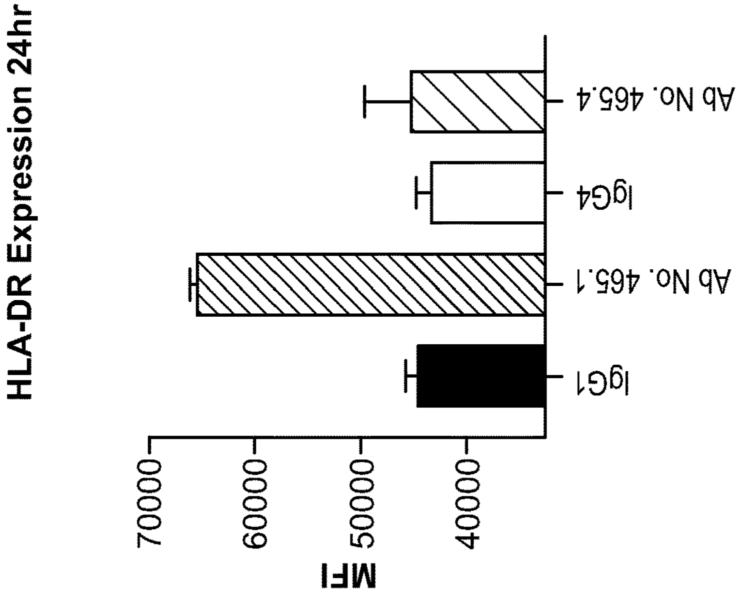
Figure 38C:
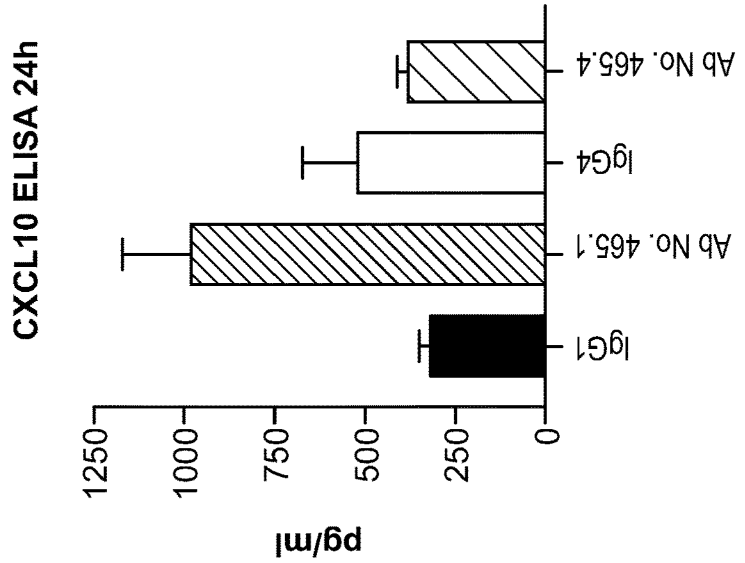
Figures 39A, 39B, 39C:
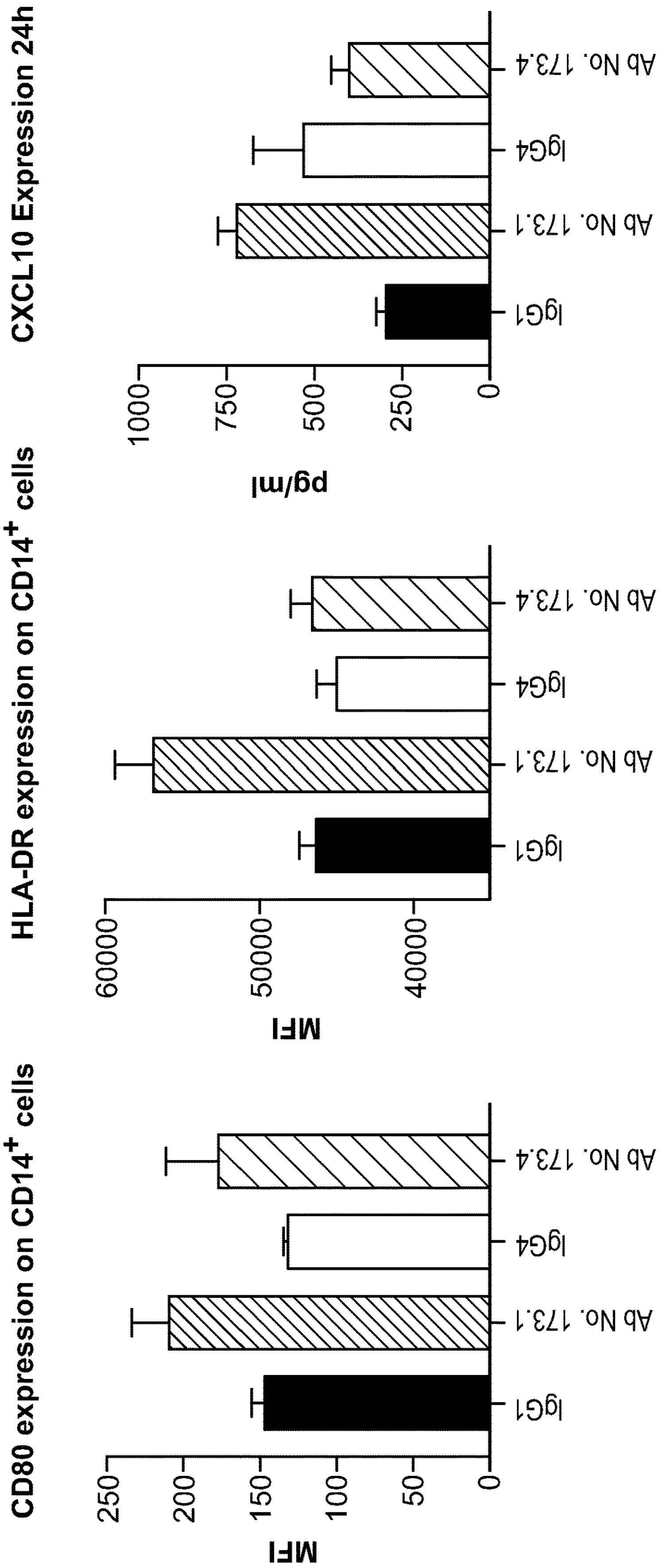
FIG. 39A-39C. Effect of anti-VISTA antibodies on upregulation of activation markers CD80 and HLA-DR on CD14+ monocytes, and effect of anti-VISTA antibodies on secretion of CXCL10 in co-culture at 24 hrs. 0.5×10$^5$ CD14+ enriched human PBMCs were co-cultured with 2×10$^5$ human PBMCs from the same donor in the presence of antibody No. 173.1 and antibody No. 173.4 or control Abs at 10 g/ml for 24 hrs. Upregulation of activation markers CD80 and HLA-DR on CD14+ cells at 24 hrs was quantified by Flow Cytometry on gated CD14+ live cells. CXCL10 secretion in co-culture at 24 hrs was quantified by ELISA (R&D Systems, catalog #DY266-05). Antibodies tested are shown on the x-axis.
Figures 40A, 40B, 40C, 40D, 40E, 40F:
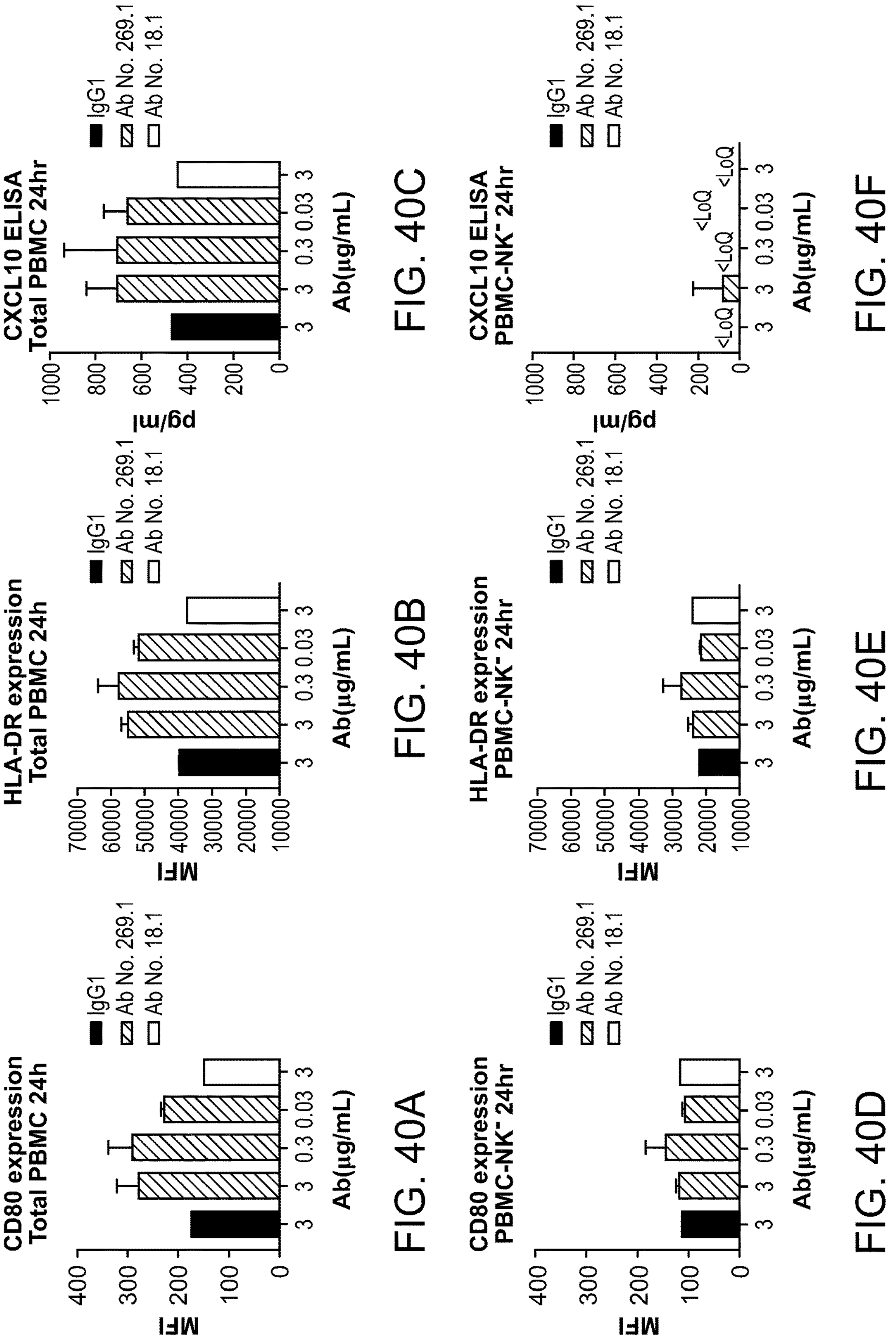
FIG. 40A-40F. Dose-titration effect of anti-VISTA antibody No. 269.1 and role of NK cells with respect to upregulation of activation markers CD80 and HLA-DR on CD14+ monocytes, effect of anti-VISTA antibodies on the secretion of CXCL10 in co-culture at 24 hrs. 0.5×10$^5$ CD14+ enriched human PBMCs were co-cultured with 2×10$^5$ human total PBMCs (FIGS. 40A-40C) or NK-depleted human PBMCs (FIGS. 40D-40F) from the same donor in the presence of Antibody No. 269.1 at 3, 0.3, or 0.03 μg/ml, IgG1 control, or negative control antibody No. 18.1 for 24 hrs. Upregulation of activation markers CD80 and HLA-DR on CD14+ cells at 24 hrs was quantified by MFI as determined by Flow Cytometry on gated CD14+ live cells. Secretion of CXCL10 chemokine in co-culture at 24 hrs was quantified by ELISA (R&D Systems, catalog #DY266-05).
Figure 41A:
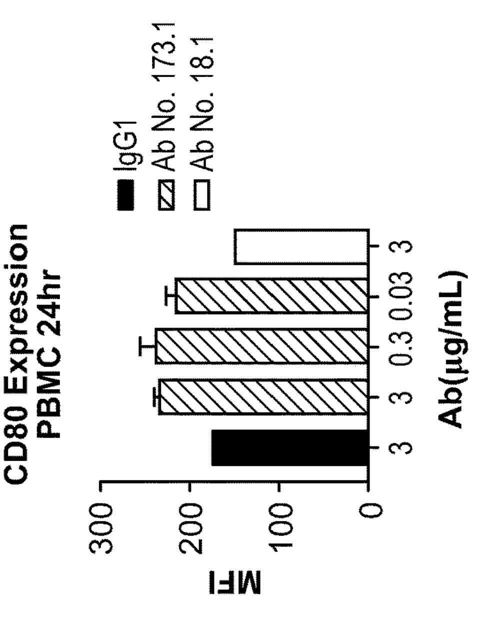
FIG. 41A-41F. Dose-titration effect of anti-VISTA antibody No. 173.1 and role of NK cells with respect to upregulation of activation markers CD80 and HLA-DR on CD14+ monocytes, effect of anti-VISTA antibodies and role of NK cells with respect to the secretion of CXCL10 in co-culture at 24 hrs. $0.5\times10^5$ cd14+ enriched human pbmcs were co-cultured with $2\times10^5$ human total PBMCs (FIGS. 41A-41C) or NK-depleted human PBMCs (FIGS. 41D-41F) from the same donor in the presence of Antibody No. 173.1 Ab tested at 3, 0.3, 0.03 μg/ml, IGG1 control, or negative control antibody No. 18.1 Ab for 24 hrs. Upregulation of activation markers CD80 and HLA-DR on CD14+ cells at 24 hrs was quantified by MFI as determined by Flow Cytometry on gated CD14+ live cells. Secretion of CXCL10 chemokine in co-culture at 24 hrs was quantified by ELISA (R&D Systems, catalog #DY266-05).
Figure 41B:
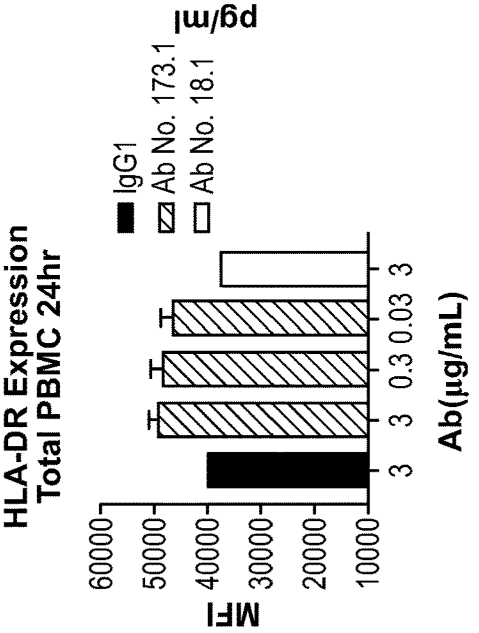
Figure 41C:
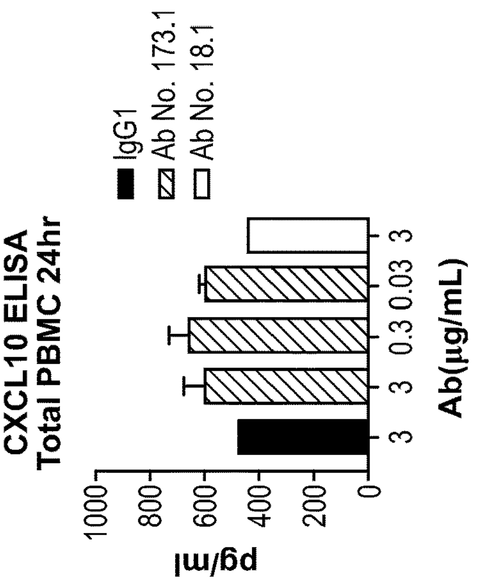
Figure 41D:
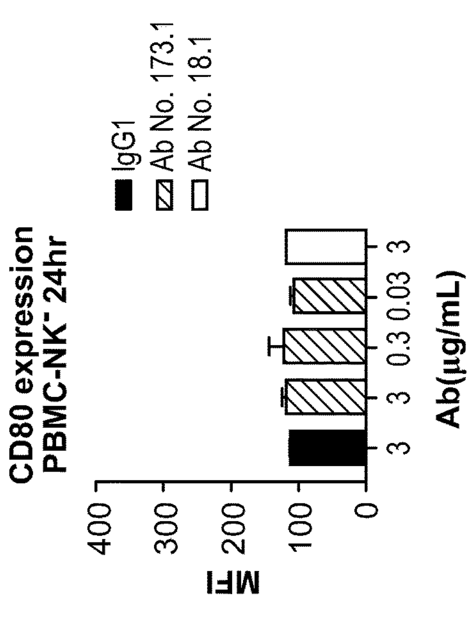
Figure 41E:
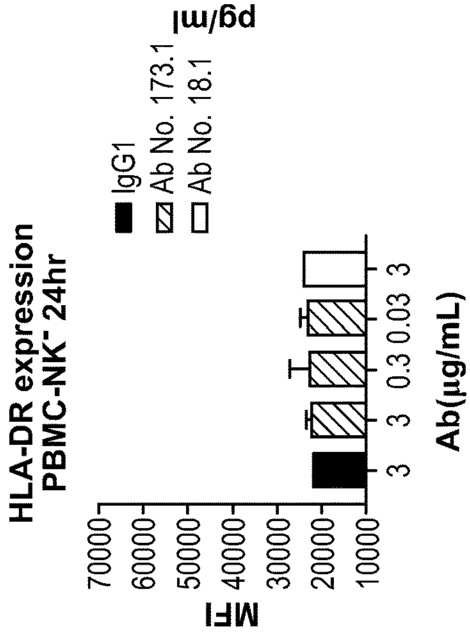
Figure 41F:
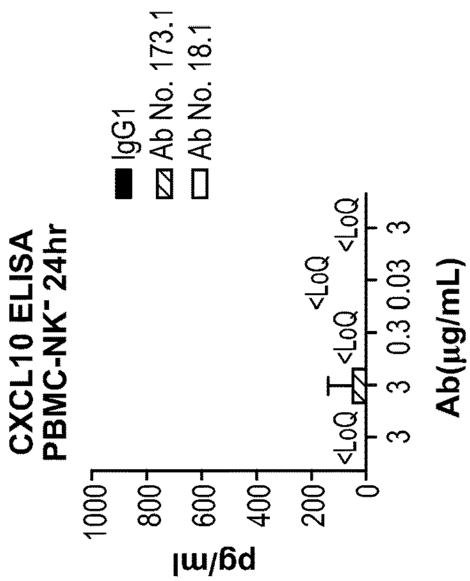
Figure 41H:
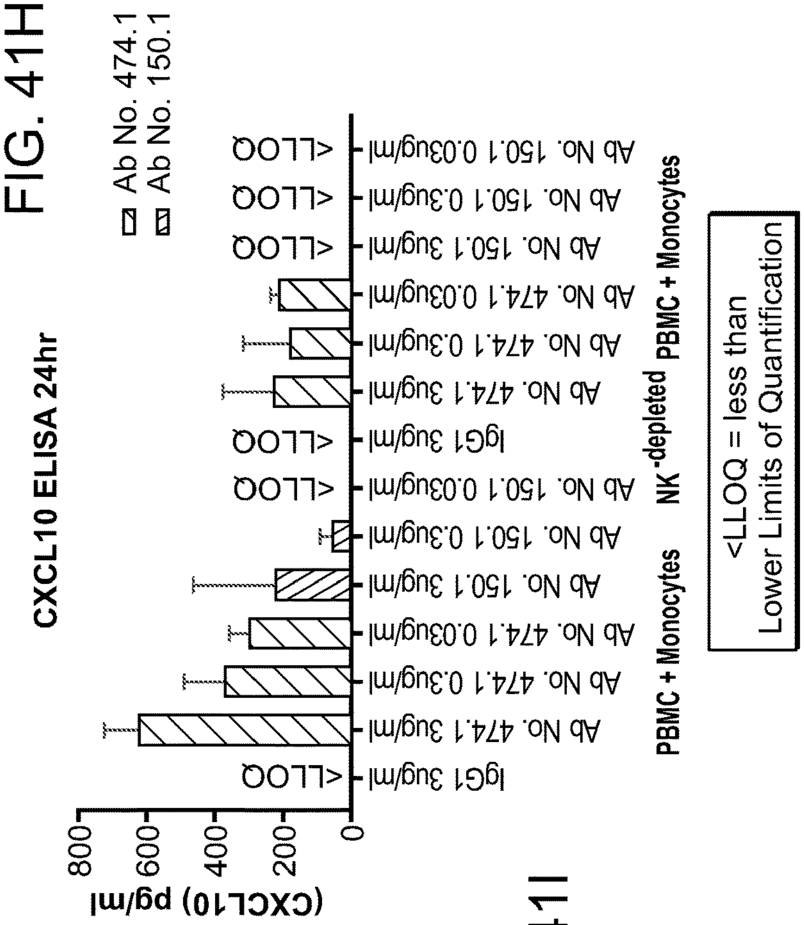
FIG. 41G-41I. Dose-response effect of Ab No. 474.1 and Ab No. 150.1 and contribution of NK cells to induced upregulation of activation marker CD80, HLA-DR at 24 hrs on CD14+ monocytes and secretion of CXCL10. $0.5\times10^5$ CD14+ enriched human PBMCs were co-cultured with either $2\times10^5$ human PBMCs, or $2\times10^5$ NK-depleted human PBMCs from the same donor in the presence of anti-VISTA Abs or isotype control Ab tested at 3, 0.3, 0.03 ug/ml for 24 hrs. Upregulation of activation marker CD80 and HLA-DR on CD14+ cells at 24 hrs was quantified by Flow Cytometry on gated CD14+ live cells. Expression of CD80 and HLA-DR on CD14+ cells in presence of total human PBMCs (left-side) or NK-depleted human PBMCs (right-side) was quantified by Mean Fluorescence Intensity (MFI). Secretion of CXCL10 chemokine was quantified by R&D Systems DuoSet ELISA Human CXCL10 kit (R&D Systems, Product #DY266).
Figure 41G:
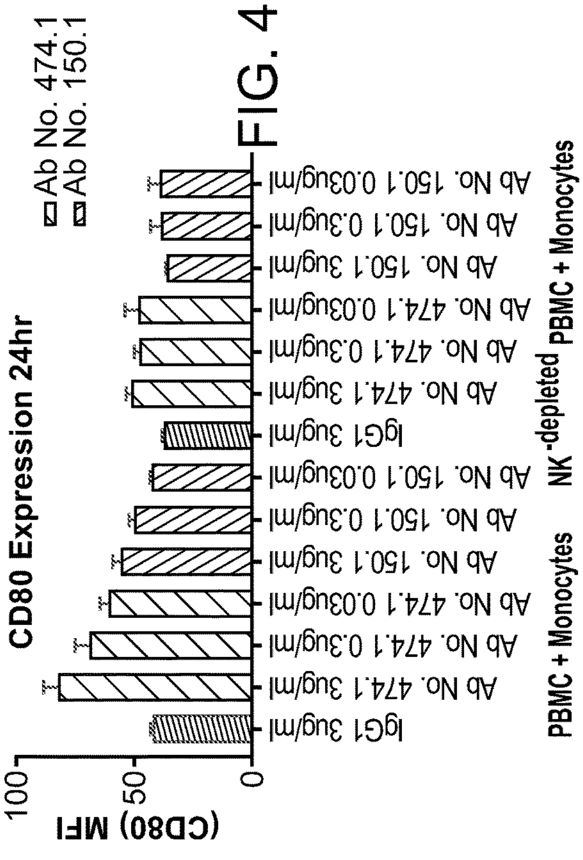
Figure 41I:
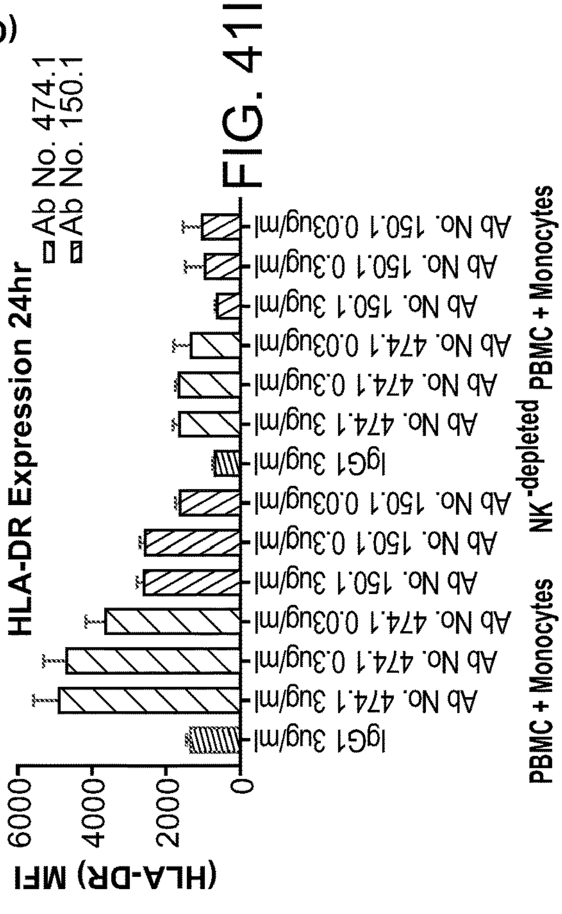
Figure 42A:
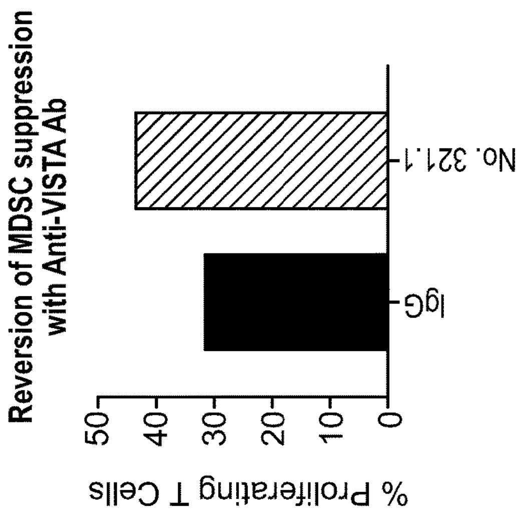
FIGS. 42A and 42B. Effect of anti-VISTA antibody No. 321.1 on suppressive activity of cytokine-induced MDSCs. Human PBMCs from a healthy donor were cultured in the presence of Granulocyte-macrophage colony-stimulating factor (GM-CSF) (10 ng/ml) and IL6 (10 ng/ml) for 7 days. After 7 days, the ability of CD11b+ cells (MDSCs) to suppress anti-CD3 Ab-induced proliferation of PBMCs in the presence of Antibody No. 321.1 or isotype control Ab was measured. PBMCs ($2\times10^5$ cells/well) were labeled with 5 mM CellTrace Violet and then added to MDSCs ($2\times10^5$ cells/well) in the presence of anti-CD3 Ab (2 μg/ml). After 4 days of incubation, T cell proliferation was determined by flow cytometry analysis (Attune Nxt) and IFNγ production was determined by ELISA (ProQuantum). Bar graphs are singlicates.
Figure 42B:
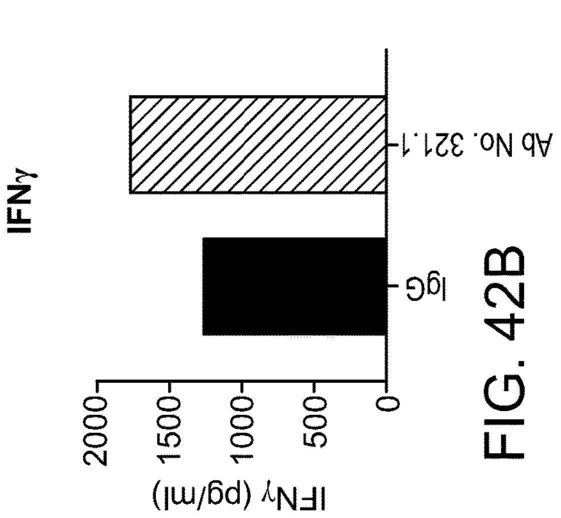
Figure 43A:
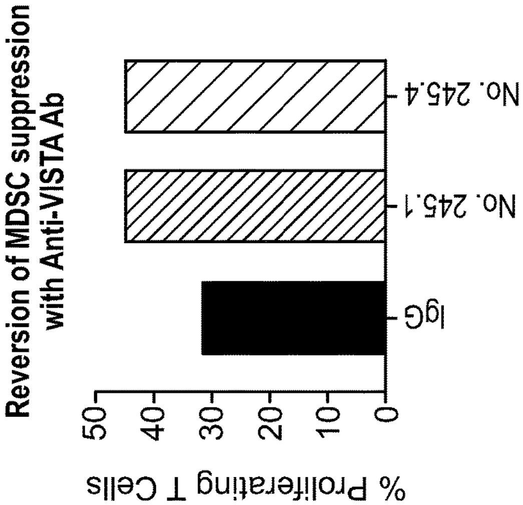
FIGS. 43A and 43B. Effect of anti-VISTA antibodies No. 245.1 and No. 245.4 on suppressive activity of cytokine-induced MDSCs. Human PBMCs from a healthy donor were cultured in the presence of GM-CSF (10 ng/ml) and IL6 (10 ng/ml) for 7 days. After 7 days, the ability of CD11b+ cells (MDSCs) to suppress anti-CD3 Ab-induced proliferation of PBMCs in the presence of Antibody No. 245.1 and Antibody No. 245.4 or isotype control Ab was measured. PBMCs ($2\times10^5$ cells/well) were labeled with 5 mM CellTrace Violet and then added to MDSCs ($2\times10^5$ cells/well) in the presence of anti-CD3 Ab (2 μg/ml). After 4 days of incubation, T cell proliferation was determined by flow cytometry analysis (Attune Nxt) and IFNγ production was determined by ELISA (ProQuantum). Bar graphs are singlicates. Antibodies tested are shown on the x-axis.
Figure 43B:
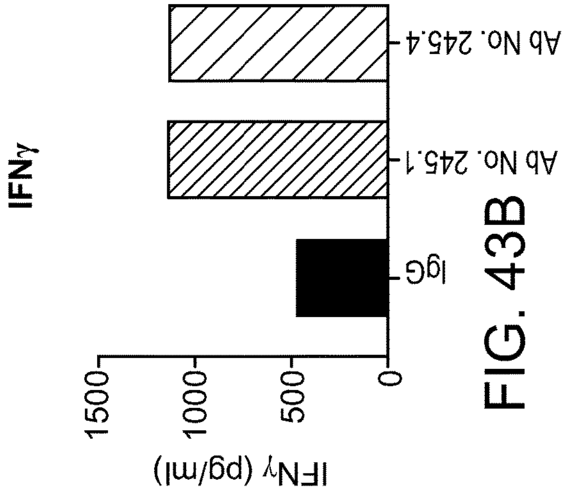
Figure 44A:
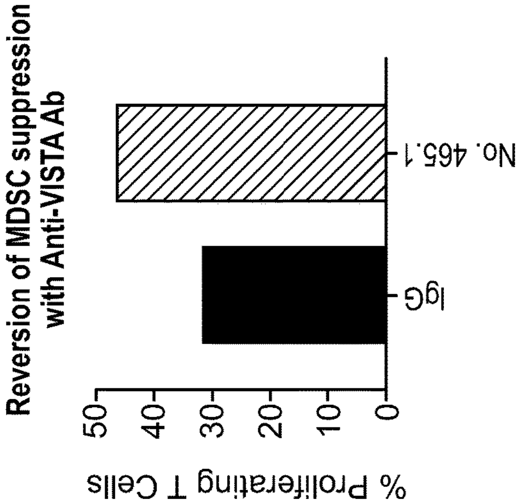
FIGS. 44A and 44B. Effect of anti-VISTA antibody No. 465.1 on suppressive activity of cytokine-induced MDSCs. Human PBMCs or CD11b+ cells from a healthy donor were cultured in the presence of GM-CSF (10 ng/ml) and IL6 (10 ng/ml) for 7 days. After 7 days, the ability of CD11b+ cells (MDSCs) to suppress anti-CD3 Ab-induced proliferation of PBMCs in the presence of Antibody No. 465.1 or isotype control Ab was measured. PBMCs ($2\times10^5$ cells/well) were labeled with 5 mM CellTrace Violet and then added to MDSCs ($2\times10^5$ cells/well) in the presence of anti-CD3 Ab (2 μg/ml). After 4 days of incubation, T cell proliferation was determined by flow cytometry analysis (Attune Nxt) and IFNγ production was determined by ELISA (ProQuantum). Bar graphs are singlicates.
Figure 44B:
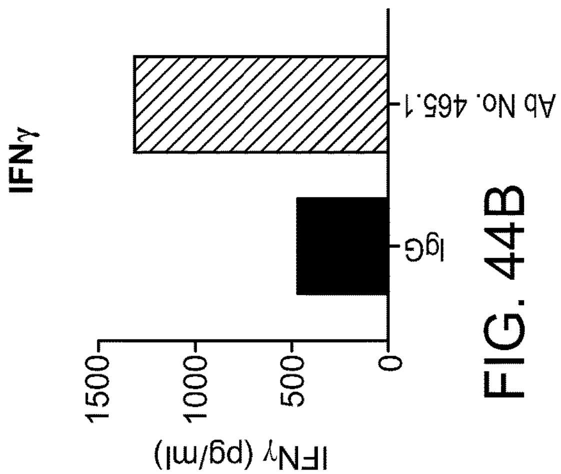
Figure 45A:
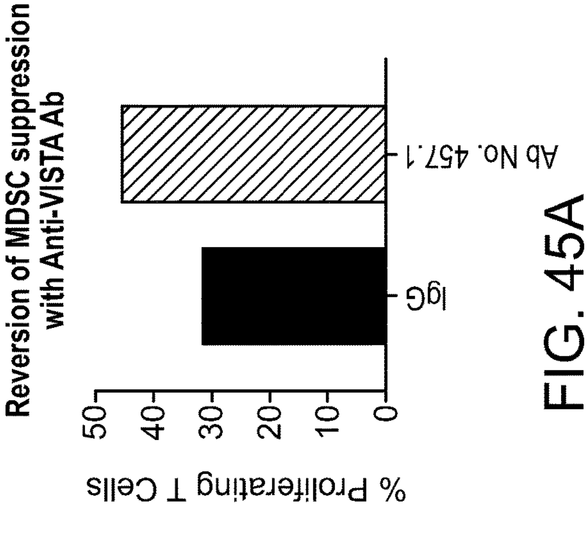
FIGS. 45A and 45B. Effect of anti-VISTA antibody No. 457.1 on suppressive activity of cytokine-induced MDSCs. Human PBMCs or CD11b+ cells from a healthy donor were cultured in the presence of GM-CSF (10 ng/ml) and IL6 (10 ng/ml) for 7 days. After 7 days, the ability of CD11b+ cells (MDSCs) to suppress anti-CD3 Ab-induced proliferation of PBMCs in the presence of Antibody No. 457.1 or isotype control Ab was measured. PBMCs ($2\times10^5$ cells/well) were labeled with 5 mM CellTrace Violet and then added to MDSCs ($2\times10^5$ cells/well) in the presence of anti-CD3 Ab (2 μg/ml). After 4 days of incubation, T cell proliferation was determined by flow cytometry analysis (Attune Nxt) and IFNγ production was determined by ELISA (ProQuantum). Bar graphs are singlicates.
Figure 45B:
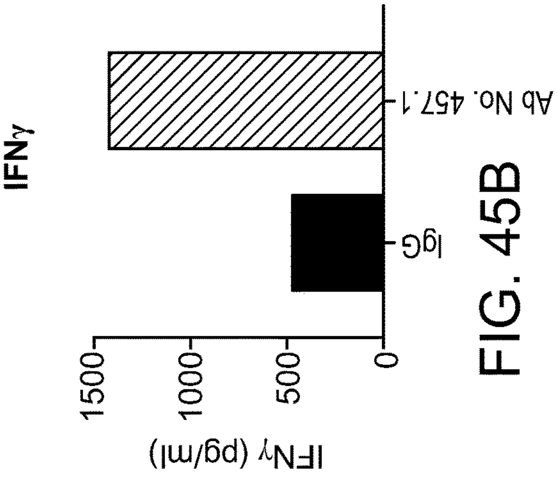
Figure 46A:
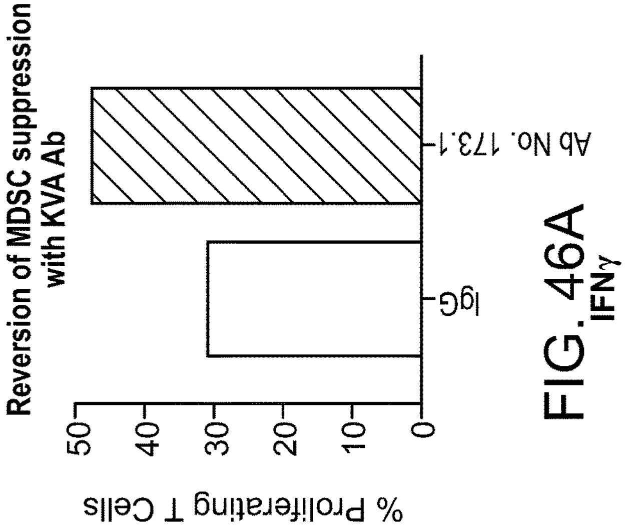
FIGS. 46A and 46B. Effect of anti-VISTA antibody No. 173.1 on suppressive activity of cytokine-induced MDSCs. Human PBMCs or CD11b+ cells from a healthy donor were cultured in the presence of GM-CSF (10 ng/ml) and IL6 (10 ng/ml) for 7 days. After 7 days, the ability of CD11b+ cells (MDSCs) to suppress anti-CD3 Ab-induced proliferation of PBMCs in the presence of Antibody No. 173.1 or isotype control Ab was measured. PBMCs ($2\times10^5$ cells/well) were labeled with 5 mM CellTrace Violet and then added to MDSCs ($2\times10^5$ cells/well) in the presence of anti-CD3 Ab (2 μg/ml). After 4 days of incubation, T cell proliferation was determined by flow cytometry analysis (Attune Nxt) and IFNγ production was determined by ELISA (ProQuantum). Bar graphs are singlicates.
Figure 46B:
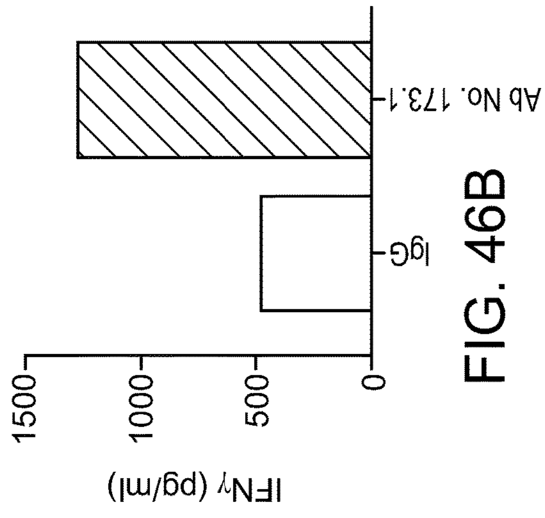
Figure 47A:
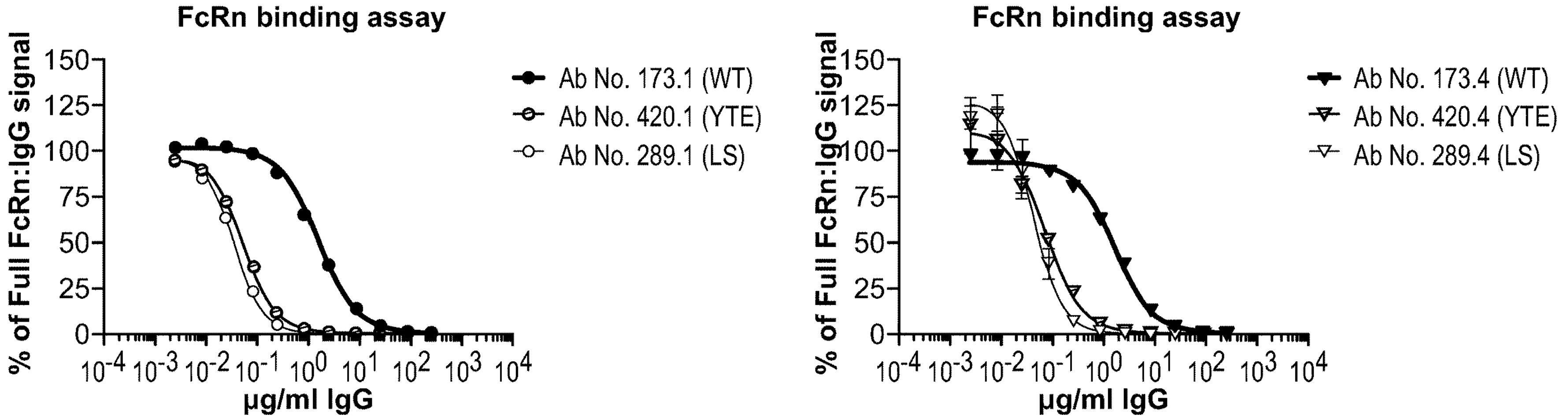
FIG. 47A. Evaluation of Fc mutants in an FcRn binding assay. Antibody No. 173 wild type (WT) on an IgG1 or an IgG4 backbone as well as the respective LS mutations, Ab No. 289 (M428L and N434S substitutions according to EU numbering) and YTE mutations, Ab No. 420 (M252Y, S254T, and T256E substitutions according to EU numbering) were tested for their ability to bind to the FcRn receptor using an AlphaLisa binding kit (Perkin Elmer #AL3095C). Anti-VISTA antibodies were prepared at a concentration of 1.2 mg/ml (4× the final concentration) before performing a semi-log serial dilution. FcRn was prepared at a concentration of 800 ng/ml (4× the final concentration), and Streptavidin donor and huIgG conjugated acceptor beads were prepared at a concentration of 20 mg/ml (2×the final concentration) before a 90 min incubation in the dark. Luminescence was read at 615 nm in a CLARIOstar spectrometer. Antibodies tested are shown in the legends.
Figure 47B:
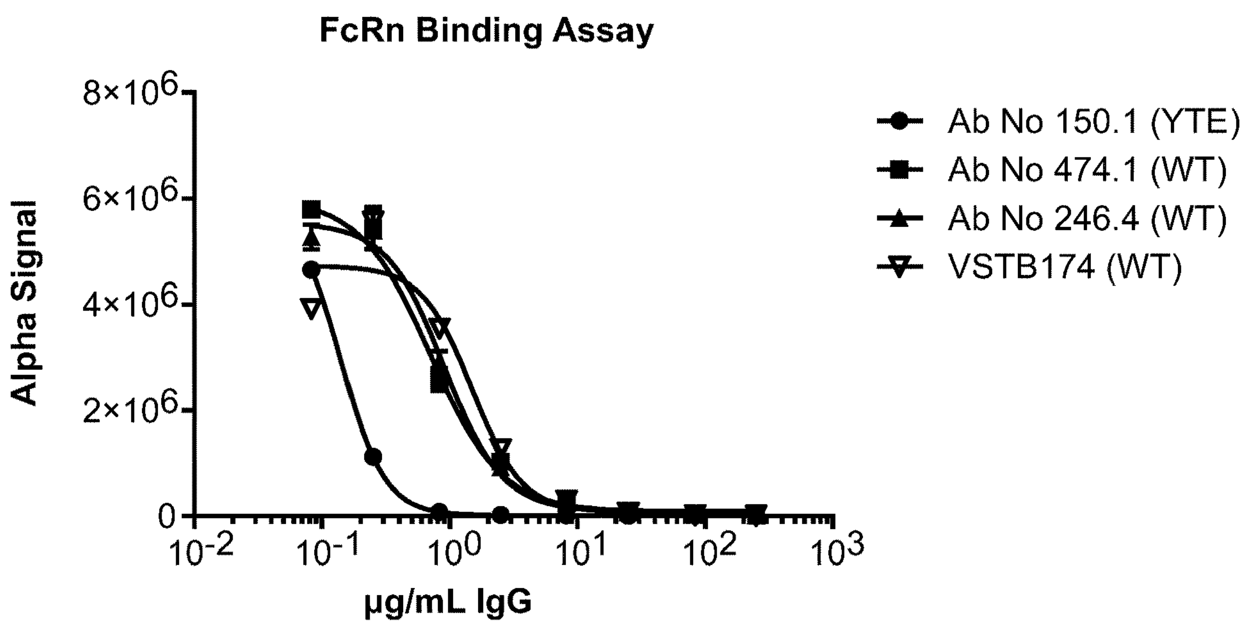
FIG. 47B. Evaluation of Fc mutants in an FcRn binding assay. Ab No. 474.1 (WT) antibodies on an IgG1 or an IgG4 S228P backbone (Ab No. 246.4) as well as the YTE mutation on an IgG1 backbone (Ab No. 150.1) were tested for their ability to bind on FcRn receptor using an AlphaLisa binding kit (Perkin Elmer #AL3095C). Anti-VISTA antibodies were prepared at a 1 mg/ml (4×) before performing a semi-log serial dilution. FcRn was prepared at 800 ng/ml (4×) and Streptavidin donor and huIgG conjugated acceptor beads at 40 mg/ml (2×) before 90 min incubation in the dark. Luminescence was read at 680 nm/615 nm (excitation/emission) in a CLARIOstar spectrometer.
Figure 48A:
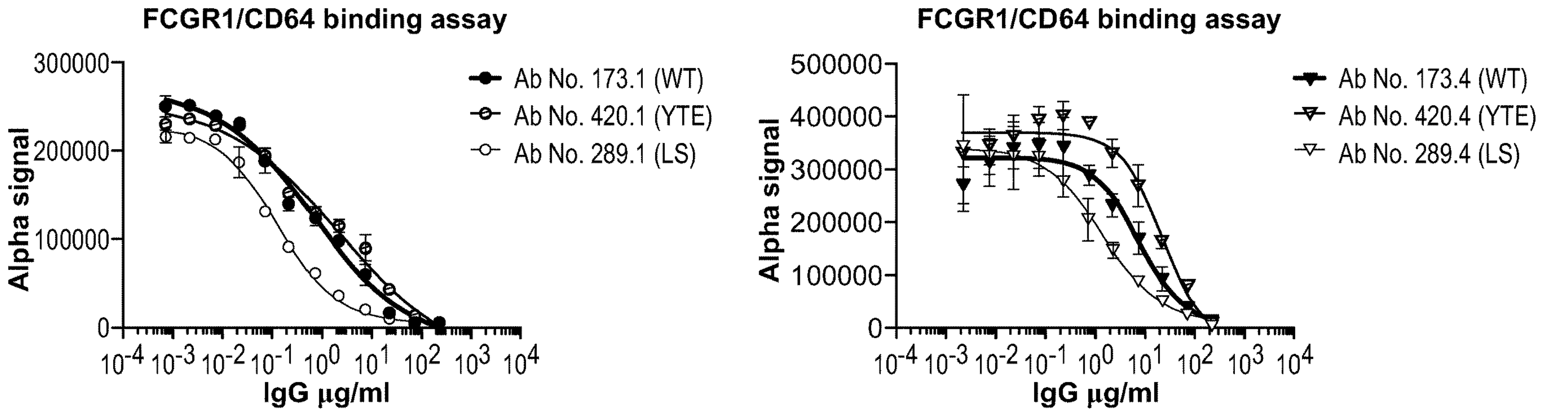
FIG. 48A. Evaluation of Fe mutants in an immunoglobulin gamma Fe receptor 1 (FcγR1) binding assay. Antibody No. 173 WT on an IgG1 or an IgG4 backbone as well as the respective LS (Ab No. 289) and YTE (Ab No. 420) mutations were tested for their ability to bind to the FcγR1 receptor using an AlphaLisa binding kit (Perkin Elmer #AL3081C). Anti-VISTA antibodies were prepared at a concentration 1.2 mg/ml (4× the final concentration) before performing a semi-log serial dilution. FcγR1 was prepared at concentration of 200 ng/ml (4× the final concentration), and Streptavidin donor and huIgG conjugated acceptor beads were prepared at a concentration of 40 mg/ml (2× the final concentration) before a 90 min incubation in the dark. Luminescence was read at 615 nm in a CLARIOstar spectrometer. Antibodies tested are shown in the legends.
Figure 48B:
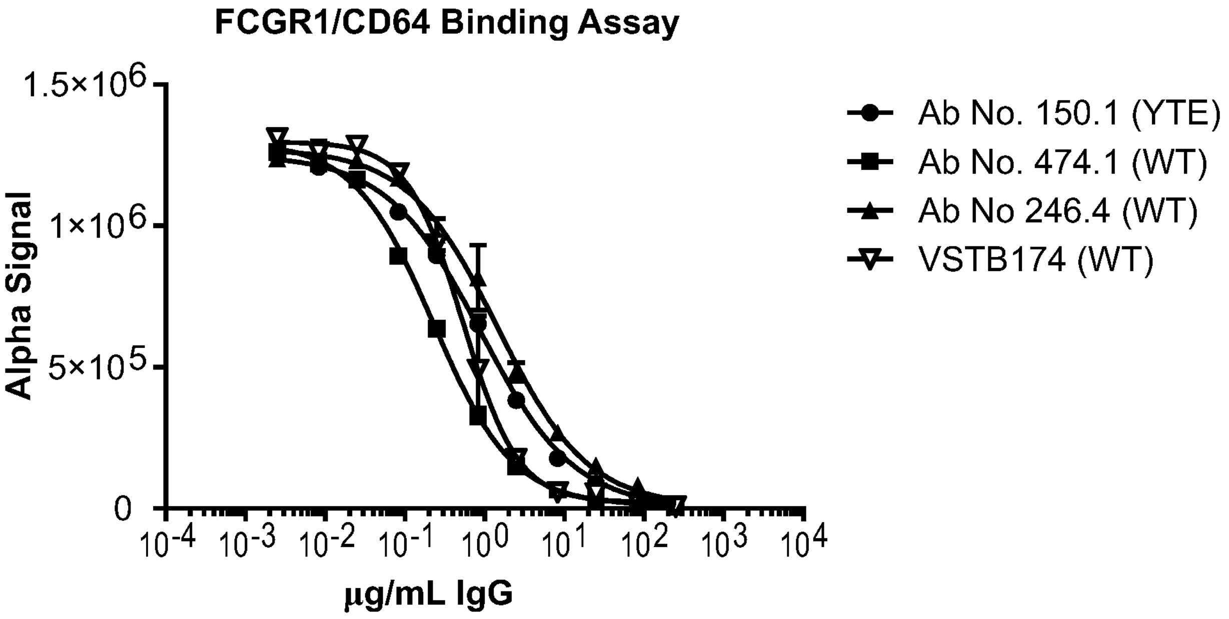
FIG. 48B. Evaluation of Fc mutant in an FcγR1 binding assay. Ab No. 474.1 (WT) antibodies on an IgG1 or an IgG4 S228P backbone (Ab No. 246.4) as well as the YTE mutation on an IgG1 backbone (Ab No. 150.1) were tested for their ability to bind on FcγR1 receptor using an AlphaLisa binding kit (Perkin Elmer #AL3081C). Anti-VISTA antibodies were prepared at a 1 mg/ml (4×) before performing a semi-log serial dilution. FcγR1 was prepared at 200 ng/ml (4×) and Streptavidin donor and huIgG conjugated acceptor beads at 40 g/ml (2×) before 90 min incubation in the dark. Luminescence was read at 680 nm/615 nm (excitation/emission) in a CLARIOstar spectrometer.
Figure 49A:
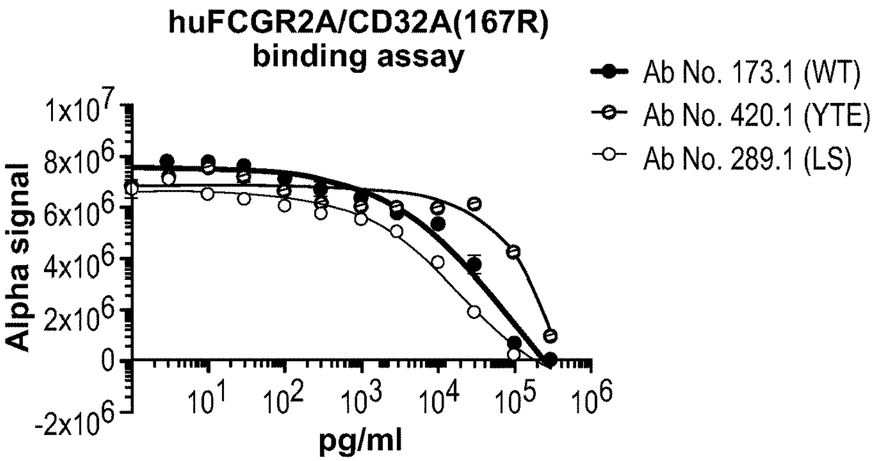
FIGS. 49A and 49B. Evaluation of Fc mutants in an immunoglobulin gamma Fc Receptor IIa (FcγR2a) (alleles 167H and 167R) binding assay. Antibody No. 173 WT on an IgG1 or an IgG4 backbone as well as their respective LS (Ab No. 289) and YTE (Ab No. 420) mutations were tested for their ability to bind to the FcγR2a receptor (Allele 167H or 167R) using an AlphaLisa binding kit (Perkin Elmer #AL3086C and #AL3087C). Anti-VISTA antibodies were prepared at a concentration of 1.2 mg/ml (4× the final concentration) before performing a semi-log serial dilution. FcγR2a (167H) was prepared at 120 ng/ml (4× the final concentration) while FcγR2a (167R) was prepared at a concentration of 200 ng/ml (4× the final concentration), and Streptavidin donor and huIgG conjugated acceptor beads were prepared at a concentration of 20 mg/ml (2× the final concentration) before a 90 min incubation in the dark. Luminescence was read at 615 nm in a CLARIOstar spectrometer. Antibodies tested are shown in the legends.
Figure 49A:
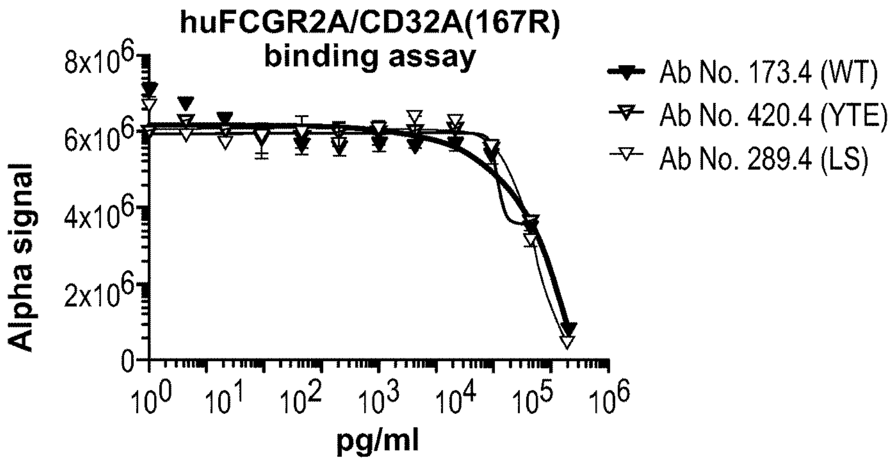
Figure 49B:
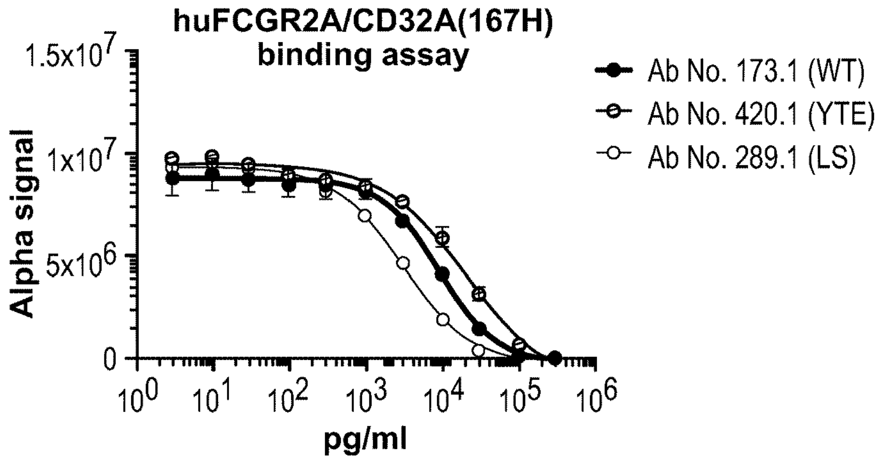
Figure 49B:
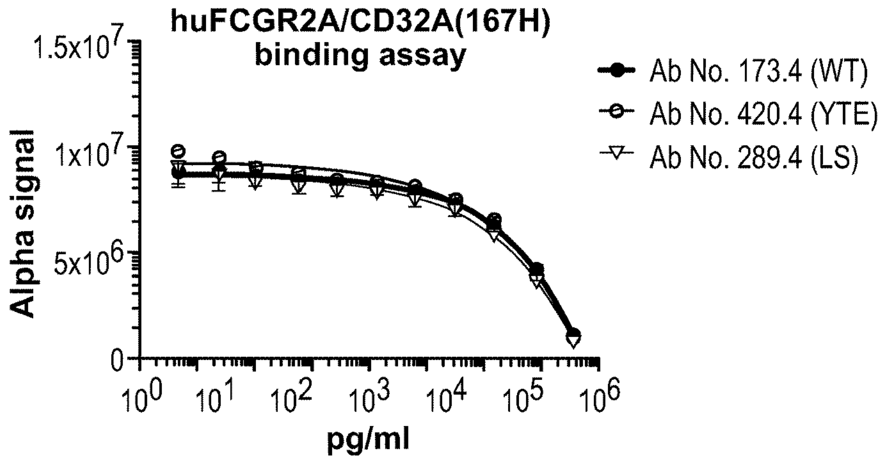
Figure 49C:
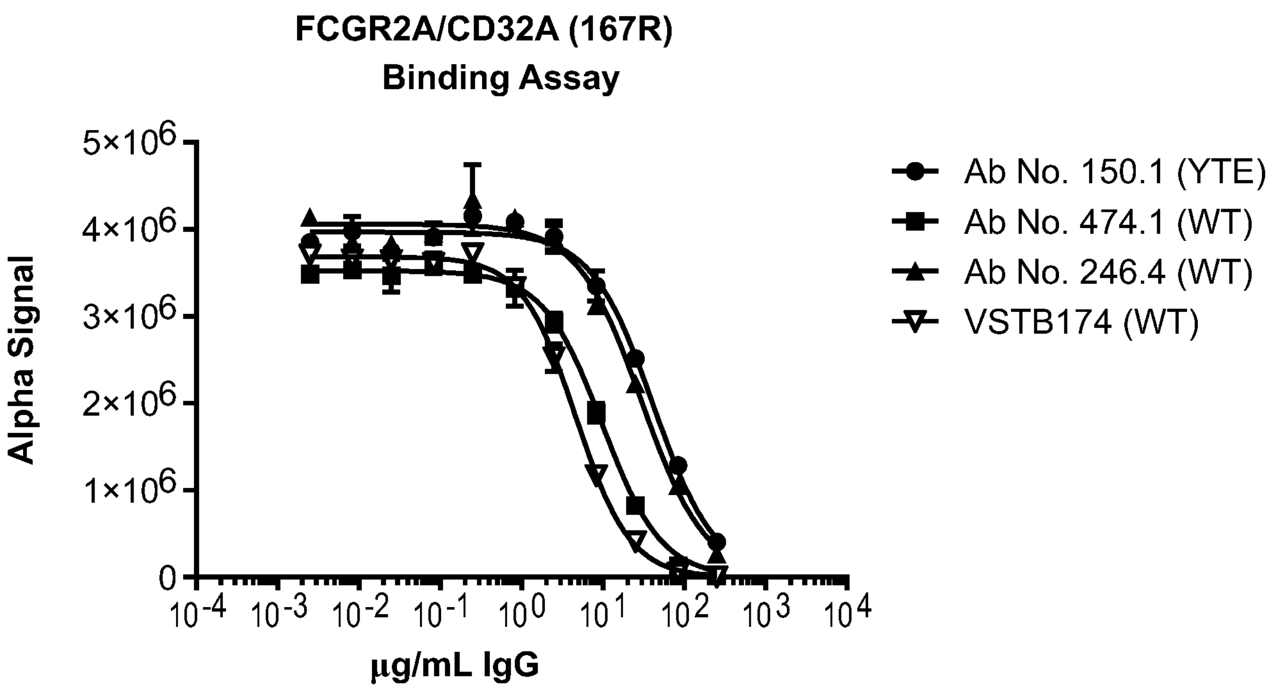
FIGS. 49C and 49D. Evaluation of Fc mutant in an FcγR2a (167H and 167R) binding assay. Ab No. 474.1 (WT) antibodies on an IgG1 or an IgG4 S228P backbone (Ab No. 246.4) as well as the YTE mutation on an IgG1 backbone (Ab No. 150.1) were tested for their ability to bind on FcγR2a receptor (Allele 167H or 167R) using an AlphaLisa binding kit (Perkin Elmer #AL3086C and #AL3087C). Anti-VISTA antibodies were prepared at a 1 mg/ml (4×) before performing a semi-log serial dilution. FcγR2a (167H) was prepared at 120 ng/ml (4×) while FcγR2a (167R) was prepared at 200 ng/ml (4×) and Streptavidin donor and huIgG conjugated acceptor beads at 20 μg/ml (2×) before 90 min incubation in the dark. Luminescence was read at 680 nm/615 nm (excitation/emission) in a CLARIOstar spectrometer.
Figure 49D:
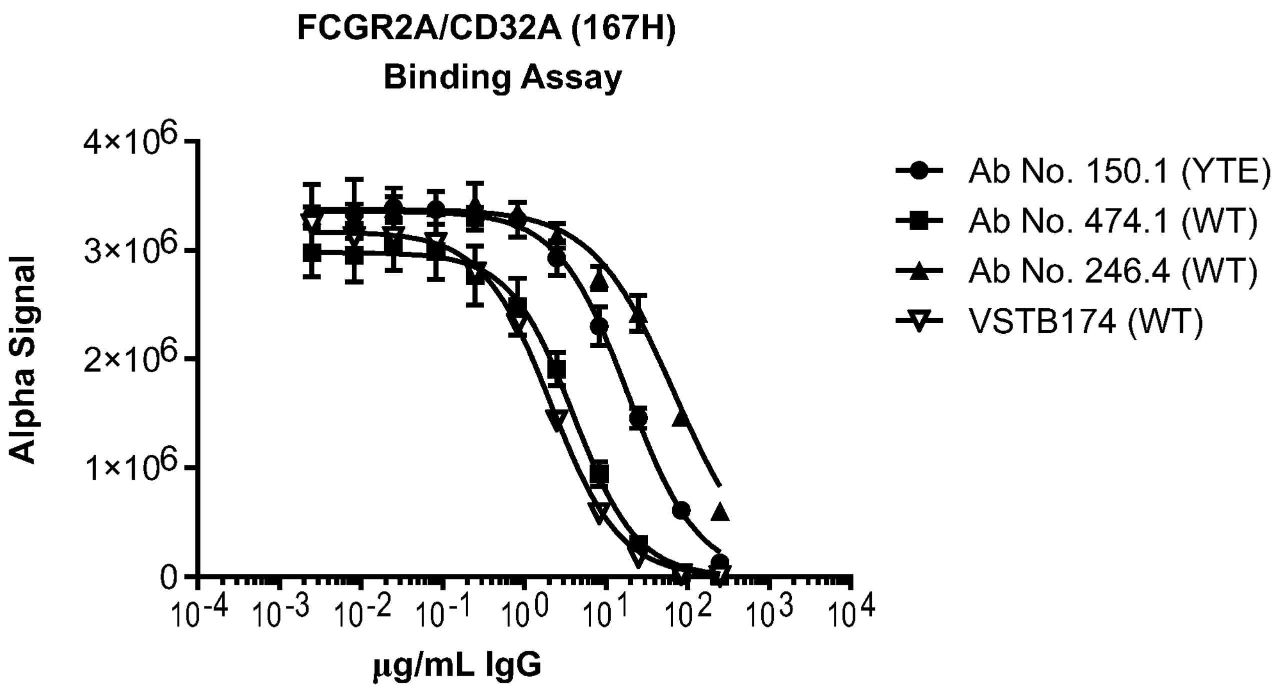

The efficacy of anti-VISTA antibodies in the monocyte activation assay is increased with the IgG1 Fe backbone compared to the IgG4 Fe backbone (FIGS. 37AD-37F, 38A-38C, 39A-39C).

To evaluate the role of NK cells in mediating efficacy of anti-VISTA antibodies in the monocyte activation assay, antibody No. 269.1, antibody No. 173.1, antibody No. 150.1 and antibody No. 474.1 as well as negative control antibody No. 18.1 were tested in the monocyte activation assay. To prepare for NK depletion, PBMCs were thawed as previously described and after centrifugation cells were resuspended at 1×108 cells/ml in EasySep Media and transferred to a 5 ml (12×75 mm) polystyrene round-bottom tube. Then, 50×106 cells/500 μl EasySep Media in a 5 ml (12×75 mm) polystyrene round-bottom tube were added to a Selection Cocktail (50 μl/ml of sample (cells)), mixed, and incubated for 6 min at room temperature. RapidSpheres (50 μl/ml of sample (cells)) were then added, mixed, and incubated for 6 min at room temperature. The final volume was adjusted at 2.5 ml with EasySep Media. The tube was placed into the magnet and incubated for 6 min at room temperature. The tube with the magnet was inverted and the supernatant transferred into a fresh tube. Then, the tube with the supernatant was placed back into the magnet and incubated for 6 min at room temperature. The tube was inverted with the magnet, and the supernatant transferred into a fresh 15 ml tube. This supernatant corresponds to the NK-depleted PBMC subset. Cell culture media was added to 12 ml final volume and the cells were centrifuged at 1500 rpm for 5 min at room temperature, and the cell pellet was resuspended in 5 ml cell culture media. Cells were counted, resuspended at 4×106 cells/ml in cell culture media, plated at 50 μl/well in 96 well U-bottom plate and placed in a 37° C. incubator for assay set-up.

The induction of expression of CD80 and HLA-DR activation markers on CD14+ cells as well as an increase of CXCL10 secretion were observed mainly in the presence of PBMCs containing NK cells. These data suggest that NK cells are necessary for anti-VISTA antibody-induced human monocyte activation (FIGS. 40A-40F, 41A-41I).

Example 14: In Vitro Functional Characterization of Anti-VISTA Antibodies in a MDSC (Cytokine-Induced) Suppression Assay The suppressive function of cytokine-induced MDSCs can be measured by their ability to inhibit anti-CD3-induced T cell proliferation (by flow cytometry) and IFNγ production (by ELISA).

Starting from total PBMC from healthy donors, cells were thawed in warm X-VIVO15 medium supplemented with CTL Anti-Aggregate, washed and counted. After centrifugation for 5 min at 400 g at room temperature, cells were resuspended at $5\times10^5$ cells/ml in X-VIVO15 medium supplemented with GM-CSF (10 ng/ml) and IL6 (10 ng/ml). Culture medium was refreshed every 2-3 days with X-VIVO15 medium supplemented with GM-CSF (10 ng/ml) and IL6 (10 ng/ml). To proceed to MDSC isolation, cells were collected from this cell culture with Detachin (non-protease cell detachment solution) at 1 ml/75 $cm^2$ and incubated at 37° C. for 5-10 min. Cells were detached with a cell scraper before proceeding to CD11b+ cell isolation using CD11b MicroBeads and LS column separation (Miltenyi) per manufacturer's instructions. Finally, MDSCs were resuspended at $2\times10^6$ cells per ml of X-VIVO15 medium.

PBMCs from the same donor-were thawed and counted before being pelleted at 400 g, 5 min. Cells were resuspended at $1\times10^6$ cells/ml in PBS and labelled with CellTrace. One μl of 5 mM Violet per ml of CellTrace was added per sample (final concentration: 5 μM CellTrace Violet) to the cells, and cells were incubated for 20 min at 37° C., in the dark. The staining was then quenched with 5 volumes of media supplemented with 10% FBS and cells were incubated for 5 min. Cell suspension was then aliquoted into 2 equal parts, pelleted at 400 g for 5 min at room temperature and resuspended at $2\times10^6$ cells/ml in X-VIVO15 medium.

Per MDSC plate, 50 μl of anti-CD3 Ab (HIT3a) at 4 μg/ml (final concentration on plate: 1 μg/mL) was added to freshly thawed PBMCs at 50 μl/well (i.e., $1\times10^5$ cells/well; $2\times10^6$ cells/mL) of a 96-well U-bottom plate. MDSCs at 50 μl/well (i.e., $1\times10^5$ cells/well; $2\times10^6$ cells/mL) were plated on the same 96-well U-bottom plate. Fifty μl/well of antibody at 40 μg/mL was added (final concentration 10 μg/mL). Cells were incubated at 37° C. in 5% $CO_2$ for 3 days before performing flow analysis for cell proliferation and ELISA for IFNγ secretion.

Anti-VISTA antibodies reversed for the most part MDSC suppression of anti-CD3 Ab-induced T cell proliferation and activation with IFNγ induced secretion (FIGS. 42A-46B).

Example 15: Evaluation of Fe Mutants in a Variety of Fe Receptor Binding Assays The objective of this study was to evaluate the Wild Type and various IgG Fc mutations in their ability to bind a range of relevant Fc receptors as a predictor of in-vivo effects of the Fc mutations. We also compared the IgG1 and IgG4 backbone for their ability to bind these Fc receptors. The following antibodies: Antibody No. 173.1 and antibody No. 474.1 (wildtype, "WT"), the respective antibody No. 420.1 and antibody No. 150.1, which both have M252Y, S254T, and T256E substitutions according to EU numbering ("YTE"), antibody No. 289.1, which has M428L and N434S substitutions relative to antibody No. 173.1 according to EU numbering, ("LS"), antibody No. 173.4 and antibody No. 246.4 (WT), antibody No. 420.4 (containing YTE) and antibody No. 289.4 (containing LS) were evaluated and compared to VSTB174 (WT) on FcRn; FCGR1/CD64; FCGR2a/CD32a (167H) & FCGR2a/CD32a (167R); and FCGR3a/CD16 (176Phe/F158) & FCGR3a/CD16a (176Val/V158) binding assays. The following AlphaLisa binding kits were used for evaluation:

FcRn (Perkin Elmer #AL3095C)

FcgR1/CD64 (Perkin Elmer #AL3081C)

FcgR2A/CD32a (167H) (Perkin Elmer #AL3086C)

FcgR2A/CD32a (167R) (Perkin Elmer #AL3087C)

FcgR3A/CD16a (176Phe/F158) (Perkin Elmer #AL347HV)

FcgR3A/CD16a (176Val/V158) (Perkin Elmer #AL348HV)

A generic FcR assay protocol was used for this study. MES buffer was used for all reagent dilutions for the FcRn binding assay and HiBlock buffer was used for all reagent dilutions for the FCGR1/CD64; FCGR2a/CD32a (167H) & FCGR2a/CD32a (167R); and FCGR3a/CD16 (176Phe/F158) & FCGR3a/CD16a (176Val/V158) binding assays. A serial dilution of the anti-VISTA antibodies was prepared starting from 100 μl of each IgG at 1 mg/mL in HiBlock or MES buffer. A 12-point semi-log dilution was prepared from stocks as follows.

TABLE 28

| Tube | Volume IgG (uL) | Volume 1X buffer (uL) | [IgG] ug/ml 4X | [IgG] ug/ml 1X |
|---|---|---|---|---|
| 1 | 100 uL 1000 ug/ml stock | 0 | 1000 ug/mL | 250 ug/mL |
| 2 | 30 uL of tube 1 | 60 | 333 ug/mL | 83.3 ug/mL |
| 3 | 30 uL of tube 2 | 70 | 100 ug/mL | 25 ug/mL |
| 4 | 30 uL of tube 3 | 60 | 33 ug/mL | 8.3 ug/mL |
| 5 | 30 uL of tube 4 | 70 | 10 ug/mL | 2.5 ug/mL |
| 6 | 30 uL of tube 5 | 60 | 3 ug/mL | 0.83 ug/mL |
| 7 | 30 uL of tube 6 | 70 | 1 ug/mL | 0.25 ug/mL |
| 8 | 30 uL of tube 7 | 60 | 0.3 ug/mL | 0.083 ug/mL |
| 9 | 30 uL of tube 8 | 70 | 0.1 ug/mL | 0.025 ug/mL |
| 10 | 30 uL of tube 9 | 60 | 0.03 ug/mL | 0.0083 ug/mL |
| 11 | 30 uL of tube 10 | 70 | 0.01 ug/mL | 0.0025 ug/mL |
| 12 | 0 | 60 | 0 ug/mL | 0 ug/mL |

A 4× solution of biotinylated Fc receptor was prepared according to the manufacturer's recommendation for each receptor. A 2× solution of human IgG Fc conjugated Acceptor Beads and Streptavidin Donor Beads were prepared according to the manufacturer's recommendation for each receptor, at either 20 μg/mL or 40 μg/mL, and was kept under subdued lighting until use. In 96 well half-area white plates, 10 μl of 4× test antibodies were added per well and then 10 μl of 4× Fc Receptor and 20 μl of 2× huIgG Fc conjugated Acceptor beads and Streptavidin Donor beads were added and mixed. The plate was incubated for 90 minutes at room temperature in the dark and read at 680 nm/615 nm (excitation/emission) in a CLARIOstar spectrometer.

In these different FcR binding assays, we showed that the YTE mutants exhibit significant improvement (5-7 fold) in FcRn binding over wild type IgG1 and wild type IgG4. The YTE mutation showed decreased binding to FCGR1A (4 fold), decreased binding to FCGR2A variants (4-5 fold), and decreased binding to FCGR3A variants (6-7 fold) over wild type IgG1. Wild type IgG4 also showed decreased binding to FCGR1A (6 fold), decreased binding to FCGR2A variants (3-14 fold), and decreased binding to FCGR3A variants (>33 fold) over wild type IgG1.

LS mutants exhibit significant improvement (3-4 folds) in FcRn binding over wild type antibodies for both IgG1 and IgG4. The LS mutants show increases in binding to FcγR1 variants over wild type IgG. The LS mutants additionally show increased binding to FcγR2 variants relative to wild type controls. The effects of the mutations are present only in the IgG1 forms, while mutations in IgG4 show no effect in FcγR2 binding. LS mutants showed little variation to wild type in FcγR3A variant binding relative to wild type when incorporated into the IgG1 construct. IgG4 LS variants were comparable to wild type (FIGS. 47A-47B, 48A-48B, 49A-49D, 50A-50D).

Example 16: Kinetics of FcRn Ligand Binding to VISTA mAb Bound to FAB2G Biosensors Neonatal Fc Receptor (FcRn) directed recycling can increase the half-life of monoclonal antibodies (mAbs) by preventing lysosomal degradation and returning the antibody to the cell surface. The objective of this study was to evaluate the kinetic interactions of an IgG1 Fc specific modification of the FcRn binding site with FcRn and confirmed by biolayer interferometry (BLI) the increased binding specificity of YTE mutant antibodies compared to WT observed previously by ELISA on FcRn Receptor. The following mAbs were compared: VSTB174, Ab No. 474.1 (WT) and No. 150.1 (YTE). The kinetics of FcRn binding with the three antibodies were measured using BLI on an Octet K2 (ForteBio) system.

Purified Ab No. 150.1, No. 474.1 and VSTB174 were loaded (Loading Step) at a 1 μg/ml concentration onto Anti-Human Fab-CH1 (FAB2G; ForteBio) dip and read biosensors for 120 seconds. Loaded biosensors were dipped (Association Step) into serial diluted FcRn (R&D systems) at 800, 200, 50 and 0 nanomolar concentrations for 240 seconds. Associated biosensors were dipped into phosphate assay buffer (PAB; 100 mM Sodium Phosphate, 150 mM NaCl, 0.05% Tween-20; pH 6.0) solution for 360 seconds (Dissociation Step). All steps including baseline, association and dissociation were performed in PAB at a pH of 6.0 to replicate the intracellular biology of the FcRn-Fc activity. A 1:1 Global curve fitting analysis was performed to determine $k_a$, $k_{dis}$, and $K_D$ across all concentrations of the FcRn analyte. The biphasic curve of dissociation was analyzed for the first 10 seconds only. Data analysis was performed using Octet Data Analysis software version 12.0.2.59. A Savitzky-Golay digital filter was used to remove high-frequency noise.

Figure 50A:
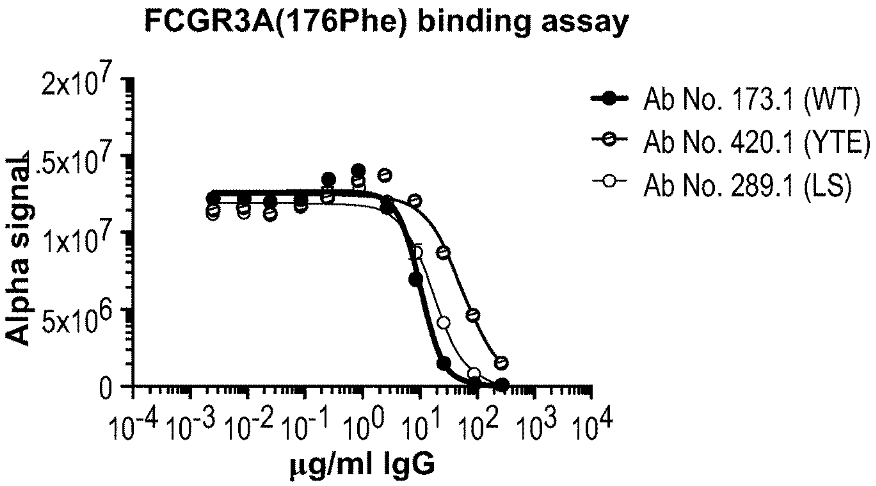
FIGS. 50A and 50B. Evaluation of Fc mutants in an immunoglobulin gamma Fc Receptor IIIa (FcγR3a) (176F and 176V alleles) binding assay. Antibody No. 173 WT on an IgG1 or an IgG4 backbone as well as their respective LS (Ab No. 289) and YTE (Ab No. 420) mutations were tested for their ability to bind to the FcγR3a receptor (Allele 176F or 176V) using an AlphaLisa binding kit (Perkin Elmer #AL347HV and #AL348HV). Anti-VISTA antibodies were prepared at a concentration of 1.2 mg/ml (4× the final concentration) before performing a semi-log serial dilution. FcγR3a (176F) was prepared at a concentration of 8 nM (4× the final concentration) while FcγR3a (176V) was prepared at a concentration of 1.2 nM (4× the final concentration), and Streptavidin donor and huIgG conjugated acceptor beads were prepared at a concentration of 40 mg/ml (2× the final concentration) before a 90 min incubation in the dark. Luminescence was read at 615 nm in a CLARIOstar spectrometer. Antibodies tested are shown in the legends.
Figure 50A:
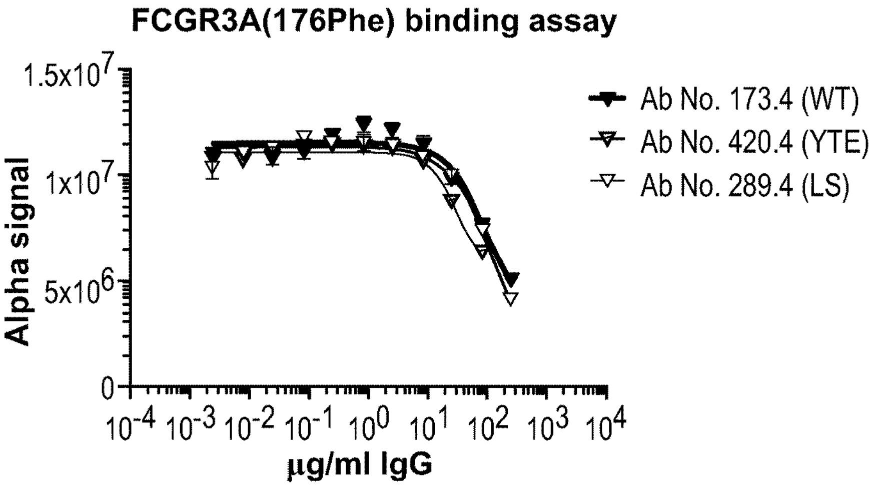
Figure 50B:
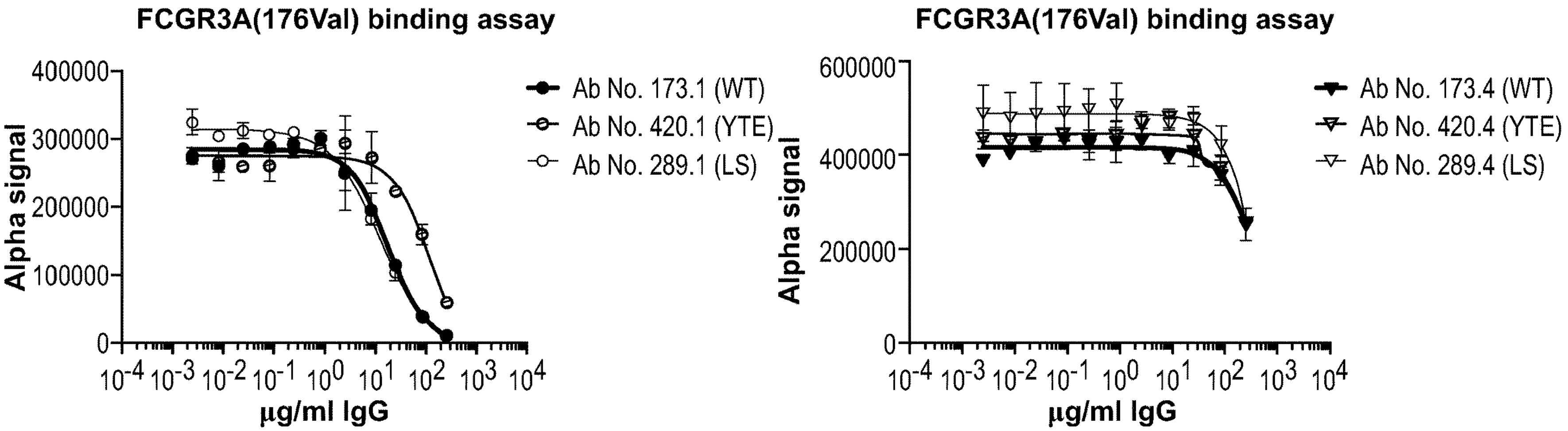
Figure 50C:
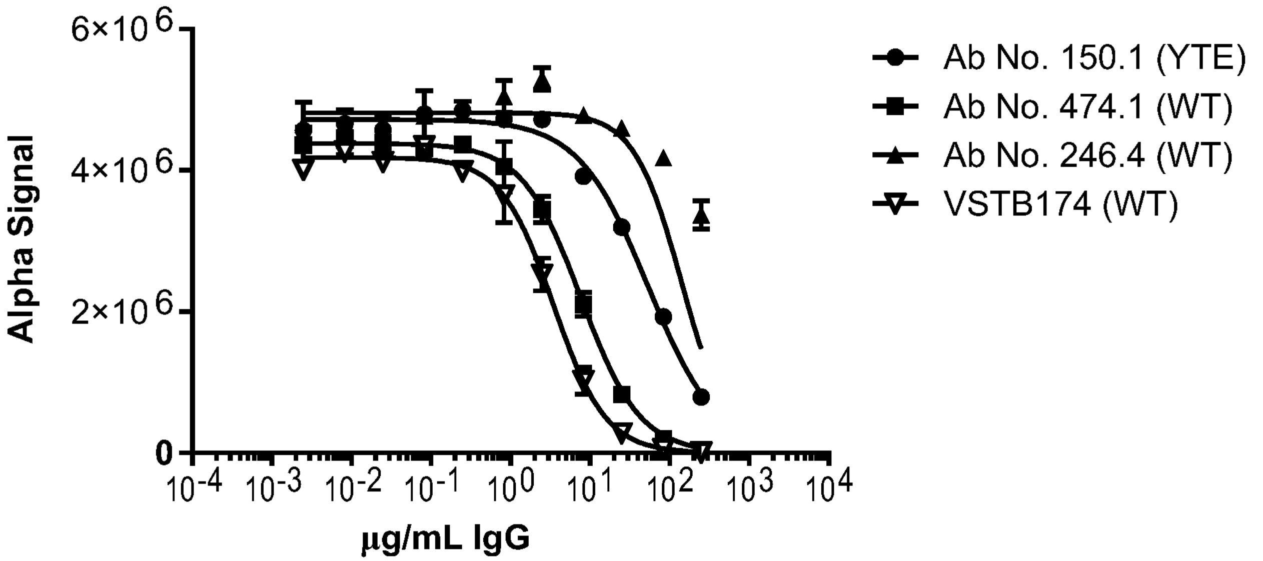
FIGS. 50C and 50D. Evaluation of Fc mutant in an FcγR3a (176F and 176V) binding assay. Ab No. 474.1 (WT) antibodies on an IgG1 or an IgG4 S228P backbone (Ab No. 246.4) as well as the YTE mutation on an IgG1 backbone (Ab No. 150.1) were tested for their ability to bind on FcγR3a receptor (Allele 176F or 176V) using an AlphaLisa binding kit (Perkin Elmer #AL347HV and #AL348HV). Anti-VISTA antibodies were prepared at a 1 mg/ml (4×) before performing a semi-log serial dilution. FcγR3a (176F) was prepared at 8 nM (4×) while FcγR3a (176V) was prepared at 1.2 nM (4×) and Streptavidin donor and huIgG conjugated acceptor beads at 40 μg/ml (2×) before 90 min incubation in the dark. Luminescence was read at 680 nm/615 nm (excitation/emission) in a CLARIOstar spectrometer.
Figure 50D:
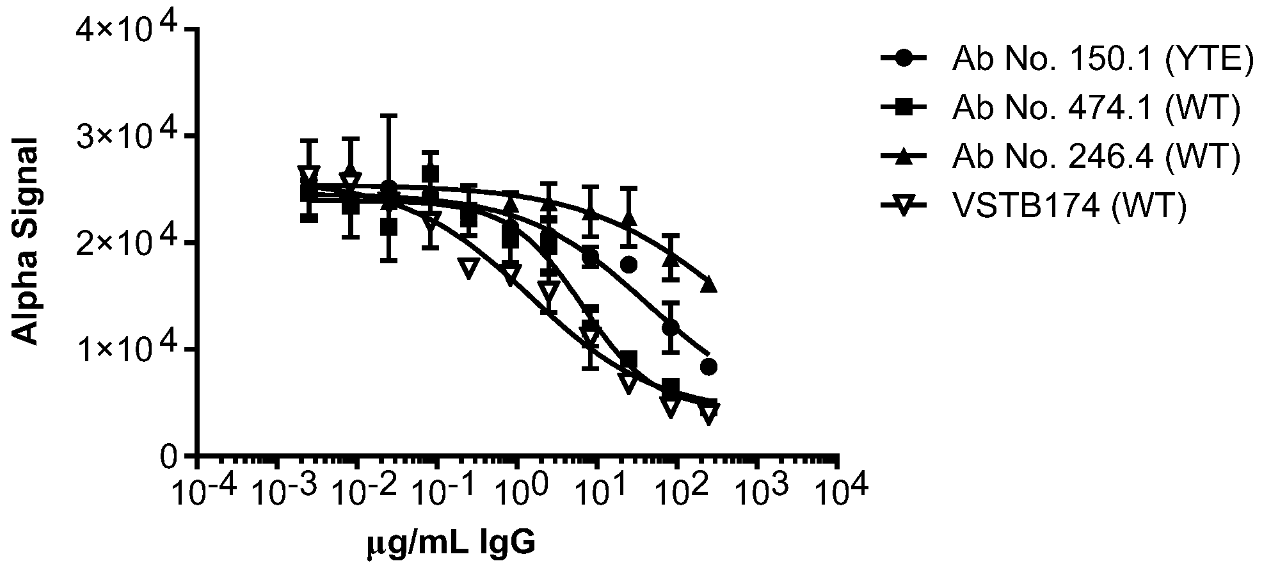
Figure 50E:
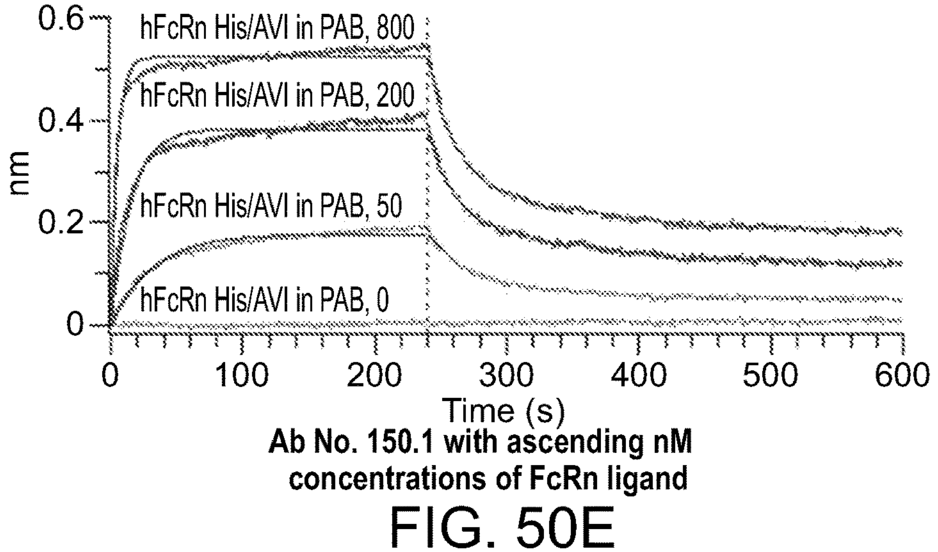
FIGS. 50E-50G. Kinetics of FcRn binding with VISTA mAbs bound to FAB2G biosensors on Octet K2 system. Abs No. 150.1, No. 474.1 and VSTB174 were loaded (Loading Step) at a 1 ug/ml concentration onto Anti-Human Fab-CH1 (FAB2G) dip and read biosensors (ForteBio) for 120 seconds. Loaded biosensors were dipped (Association Step) into FcRn (R&D systems) at 0, 50, 200 and 800 nanomolar concentrations for 240 seconds. Associated biosensors were dipped into phosphate assay buffer (PAB) solution for 360 seconds (Dissociation Step). All steps including baseline, association and dissociation were performed in PAB (pH 6.0) to replicate the intracellular biology of the FcRn-Fc activity. A 1:1 Global curve fitting analysis was performed to determine $k_a$, $k_{dis}$, and $K_D$ across all concentrations of the FcRn analyte. The biphasic curve of dissociation was analyzed for the first 10 seconds only. Kinetic experiments were performed on an ForteBio Octet K2 system and analyzed using the ForteBio Data Analysis HT software version 12.0.2.59.
Figure 50F:
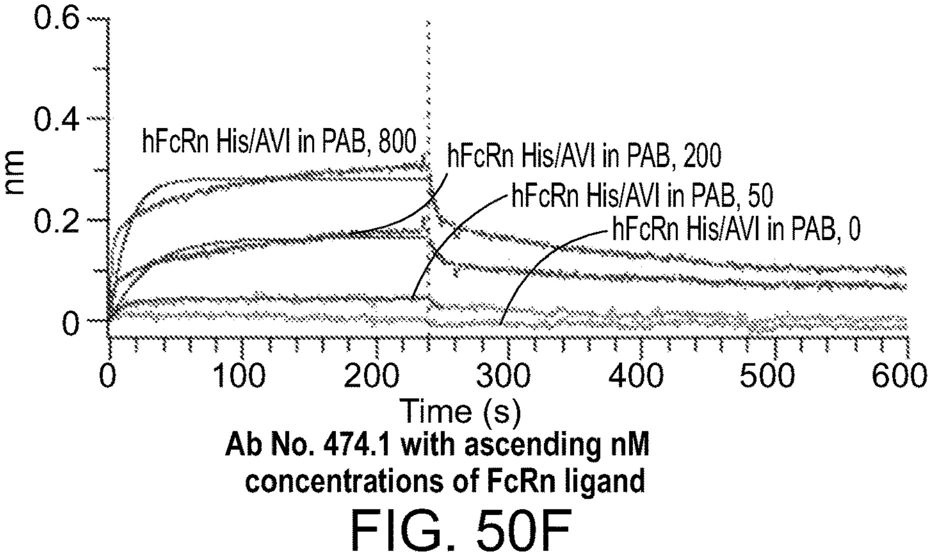
Figure 50G:
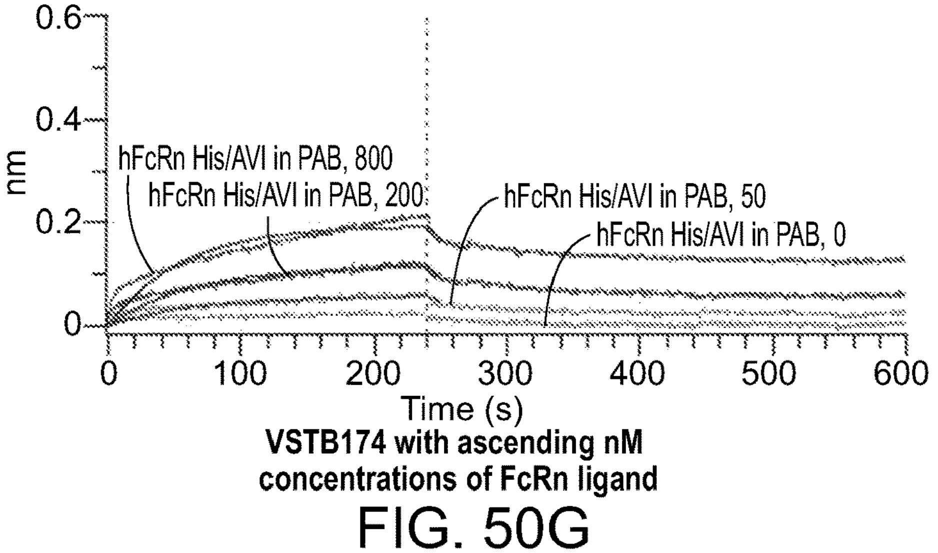
Figure 51:
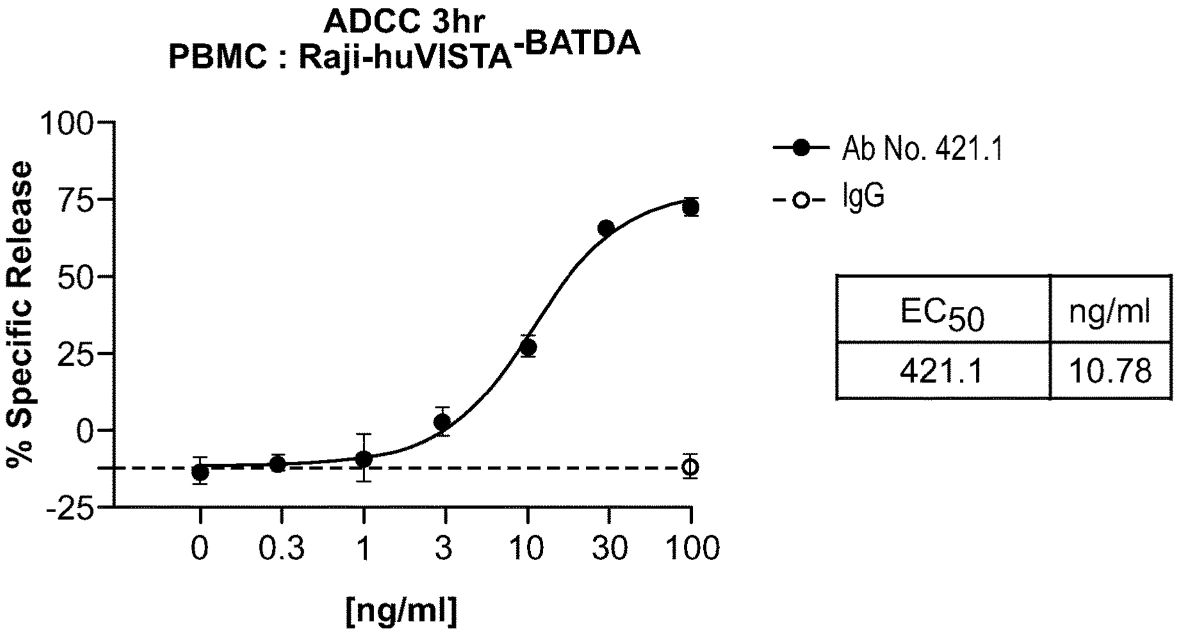
FIG. 51. Dose-response effect of anti-VISTA antibody No. 421.1 with effector PBMCs on ADCC activity against target Raji cells expressing human VISTA (Raji-hVISTA cells) at 3 hrs. Effector cells ($5\times10^5$ human PBMCs) were co-cultured with target cells ($1\times10^4$ Raji-hVISTA cells labelled with BATDA) in the presence of antibody No. 421.1 or control Ab at 100, 30, 10, 3.0, 1.0, or 0.3 ng/ml for 3 hrs. Induced ADCC activity was quantified on a CLARIOstar Plus by short term time-resolved fluorometry detection of DELFIA® EuTDA Cytotoxicity Reagents.
Figure 52:
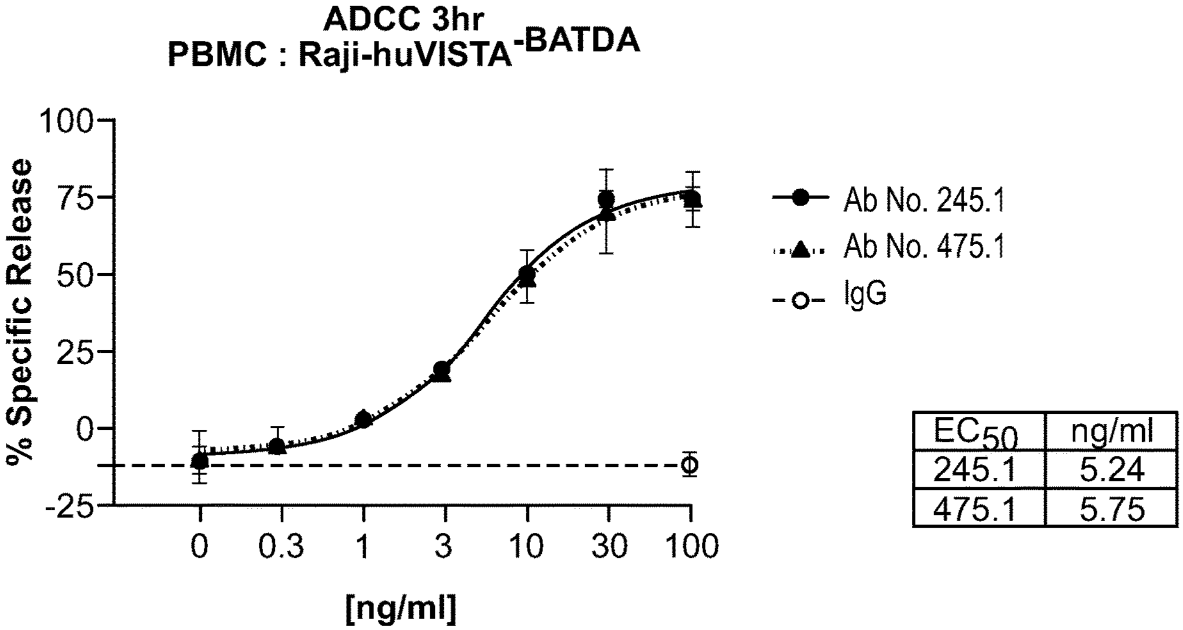
FIG. 52. Dose-response effect of anti-VISTA antibodies No. 245.1 and No. 475.1 with effector PBMCs on ADCC activity against target Raji cells expressing human VISTA (Raji-hVISTA cells)at 3 hrs. Effector cells ($5\times10^5$ human PBMCs) were co-cultured with target cells ($1\times10^4$ Raji-hVISTA cells labelled with BATDA) in the presence of antibody No. 245.1 (WT), antibody No. 475.1 (LS) or control Ab at 100, 30, 10, 3.0, 1.0, or 0.3 ng/ml for 3 hrs.

Three sensorgram graphs were created for each mAb. The biphasic curves of the four concentrations of the FcRn ligand to each mAb were overlapped in ascending concentrations from the bottom to the top of the graphs in FIGS. 50E-50G. Ab no. 150.1 (YTE) had the strongest affinity to the FcRn ligand with an average KD of 8.41E-08 across the average of the four biphasic curves. This is a 11-fold increase over the Wild Type antibody No. 474.1. The response of the curves, which can indicate the amount of the bound ligand, is also increased by the FcRn modification of Ab No. 150.1. In total, the modification of the FcRn binding site on Ab No. 150.1 enhanced the strength of the interactions between the analyte and antibody both by the KD and response measurements. This experiment illustrates why the half-life of Ab No. 150.1 is increased in-vivo.

TABLE 29

| Ligand | Ligand Conc. (nM) | Loading Sample ID | Loading Conc. (μg/ml) | Response | KD (M) | ka (1/Ms) | kdis (1/s) |
|---|---|---|---|---|---|---|---|
| rhFcRn (R&D) | 800 | Ab No. 150.1 in PAB | 1 | 0.5425 | 8.41E−08 | 2.28E+05 | 1.92E−02 |
| rhFcRn (R&D) | 200 | Ab No. 150.1 in PAB | 1 | 0.4076 | 8.41E−08 | 2.28E+05 | 1.92E−02 |
| rhFcRn (R&D) | 50 | Ab No. 150.1 in PAB | 1 | 0.1919 | 8.41E−08 | 2.28E+05 | 1.92E−02 |
| rhFcRn (R&D) | 0 | Ab No. 150.1 in PAB | 1 | 0.0059 | | | |

TABLE 29-continued

| Ligand | Ligand Conc. (nM) | Loading Sample ID | Loading Conc. (μg/ml) | Response | KD (M) | ka (1/Ms) | kdis (1/s) |
|---|---|---|---|---|---|---|---|
| rhFcRn (R&D) | 800 | Ab No. 474.1 in PAB | 1 | 0.3073 | 7.63E−07 | 4.67E+04 | 3.56E−02 |
| rhFcRn (R&D) | 200 | Ab No. 474.1 in PAB | 1 | 0.1799 | 7.63E−07 | 4.67E+04 | 3.56E−02 |
| rhFcRn (R&D) | 50 | Ab No. 474.1 in PAB | 1 | 0.048 | 7.63E−07 | 4.67E+04 | 3.56E−02 |
| rhFcRn (R&D) | 0 | Ab No. 474.1 in PAB | 1 | 0.0044 | | | |
| rhFcRn (R&D) | 800 | VSTB174 in PAB | 1 | 0.2113 | 4.45E−06 | 3.45E+03 | 1.54E−02 |
| rhFcRn (R&D) | 200 | VSTB174 in PAB | 1 | 0.1207 | 4.45E−06 | 3.45E+03 | 1.54E−02 |
| rhFcRn (R&D) | 50 | VSTB174 in PAB | 1 | 0.0594 | 4.45E−06 | 3.45E+03 | 1.54E−02 |
| rhFcRn (R&D) | 0 | VSTB174 in PAB | 1 | 0.0227 | | | |

Example 17: In Vitro Functional Characterization of Anti-VISTA Mab to Induce ADCC (Antibody Dependent Cell Cytotoxicity)

Anti-VISTA antibody activity was evaluated in an ADCC (Antibody Dependent Cell Cytotoxicity) assay. A dose-titration was performed to test antibody No. 465.1, antibody No. 173.1, antibody No. 420.1 and antibody No. 173.4 at 100, 30, 10, 3.0, 1.0, and 0.3 ng/ml in the DELFIA ADCC Assay with Effector Cells (healthy donor PBMCs) and Target Cells (Raji-hVISTA cells, InvivoGen).

Effector Cells (human PBMC) were prepared at a [50:1] ratio: [Effector:Target]([5×10$^5$ PBMC: 1×10$^4$ Raji-hVISTA cells labelled with BATDA]). The effector human PBMCs were cultured overnight in PBMC culture media at 1×10$^6$ cells/ml with IL-2 at 50 U/ml and then harvested and pelleted at 1500 rpm for 5 min at room temperature. Cells were counted and resuspended at 5×10$^6$ cells/ml in Assay Culture Media (5×10$^5$ PBMC/ADCC Assay well). Raji-hVISTA cells were harvested from standing culture, pelleted at 1500 rpm for 5 min at room temperature, counted and resuspended at 4×10$^6$ Raji-hVISTA cells in 4 ml Loading Buffer (1×10$^6$/ml cell suspension). Five μl BATDA was added and cells were incubated for 20 min at 37° C. with 5% $CO_2$. After washes with loading buffer, cells were counted and resuspended at 2×10$^5$ cells/ml in Assay Culture Media. A serial dilution of tested antibodies was prepared at 50 μl/well. Conditions for Background, Spontaneous Release & Maximum Release were set-up as follow:

- Background=1 ml culture media was removed from final Target$^{-BATDA}$ suspension, centrifuged at 1500 rpm, 5 min, at room temperature and Applied (3×) 50 μl/well "Background Supernatant"+(3×) 150 μl Assay Culture Media
- Spontaneous Release=50 μl/well Target$^{-BATDA}$+150 μl Assay Culture Media
- Maximum Release=50 μl/well Target$^{-BATDA}$+130 μl Assay Culture Media+20 μl (warmed) Lysis Buffer Then Target Cells (Raji-hVISTA$^{-BATDA}$) were cultured at 50 μl/well [1×10$^4$/well] with Effector Cells (PBMCs) at 100 μl/well [5×10$^5$/well] for a Final [50:1] Ratio. The co-culture was incubated for 2 and 3 hr at 37° C., 5% CO2. 200 μl/well of Europium Solution was prepared in DELFIA kit 96-well flat-bottom strip-well readout plate and 20 μl/well supernatant from the ADCC Assay Culture Plate was transferred into it and then incubated for 15 mins at room temperature on a 240 rpm shaker. Then EuTDA fluorescence was measured on CLARIOstar Plus Plate Reader.

This assay demonstrated that anti-VISTAantibody No. 421.1, antibody No. 245.1, antibody No. 475.1 (LS), antibody No. 465.1, antibody No. 457.1, and antibody No. 173.1 induced ADCC activity against Raji-hVISTA target cells. Antibody No. 245.1 and antibody No. 475.1 (LS) showed nearly identical induced ADCC activity. Antibody No. 173.1 (WT) had a higher rate of induced ADCC activity and a lower EC50 value than antibody No. 420.1 (YTE). Antibody No. 173.4 demonstrated a low level of induced ADCC activity against Raji-hVISTA target cells compared to antibody No. 173.1 (FIGS. 51-55A).

Antibodies No. 474.1, No. 150.1 and No. 246.4 activity were evaluated in a separate ADCC (Antibody Dependent Cell Cytotoxicity) assay and compared to VSTB174. A dose-titration was performed to test anti-VISTA antibody (100 pg/mL-10 mg/mL) in the ADCC assay with Effector cells (PBMCs from 6 healthy donors treated with 200 U/mL of IL-2 O/N at 37° C. in X-VIVO-15 medium) and Target cells (Raji-hVISTA overexpressing cells) with a [12:1] ratio. Cell death was detected using CytoToxGlo™ reagent (Promega) after 4-hour incubation at 37° C. Relative luminescent units (RLU) were measured using ClarioStar BMG plate reader. Fold increase of dead cells over non-treated negative control was plotted. Inhibition curves were fitted using the Levenberg-Marquardt algorithm. Half maximal effective concentration ($EC_{50}$) was defined as the concentration of antibody which induces a response halfway between the baseline and maximum. (FIGS. 55B-55C). These data shows that VST174 and antibody No. 474.1 (WT) induced strong ADCC activity against Raji-hVISTA target cells while antibody No. 150.1 (YTE) demonstrates a reduced ADCC activity against Raji-hVISTA.

Example 18: In Vitro Functional Characterization of Anti-VISTA Mab to Induce CDC (Complement Dependent Cytotoxicity)

Anti-VISTA antibodies activity was evaluated in a CDC (Complement Dependent Cytotoxicity) assay. A dose-titration was performed to test antibody No. 474.1, antibody No. 150.1, and antibody No. 246.4 at 100, 10, 1.0, 0.1, 0.01, and 0.001 ng/ml and compared to VSTB174. hVISTA-Raji cells were seeded at a density of 100,000 cells/well onto white 96-well flat bottom tissue culture assay plate in 100 μL of X-vivo medium. Antibodies were serially diluted in the X-Vivo-15 medium in 96-well V bottom polypropylene plate. 50 μL of antibodies were transferred into assay plate wells. 50 μL of human universal AB serum (Sigma) was added to the assay plate wells. Each well was mixed 100 ul three times. The assay plates were then incubated for 6 hours in the 37° C., 5% $CO_2$ humidified incubator. The cells were assayed using a CellTox-Glo Cytotoxicity Assay Kit (Promega), and the data were read using ClarioStar Plus (BMG Labtech). Rituximab was used as a positive control. Except VSTB174 none of the tested anti-VISTA Abs induced strong CDC (FIG. 55D).

Example 19: In Silico Characterization of Anti-VISTA Antibodies

The amino acid sequences of anti-VISTA antibodies were analyzed in silico for potential sequence-dependent development liabilities of the CDR regions, including assessment of covariance violations, non-standard glycosylation sites, non-standard cysteine placement, salt bridge disruptions, isoelectric point (pI), risk of deamidation, risk of tryptophan oxidation, risk of isomerization and calculation of surface area with high positive, negative or hydrophobic character. In general, such potential liabilities could manifest as sites of degradation (e.g. deamidation, oxidation), isomerization (e.g. Asp-isoAsp), production titer limitations, purification challenges, aggregation and formulation challenges and deleterious effects on pharmacokinetics, non-specific binding in vivo as well as changes to biodistribution. Among the sequences analyzed, antibody No. 269.1, antibody No. 321.1, antibody No. 245.1 and antibody No. 457.1 had no major development liabilities. Sequences of antibody No. 465.1 and antibody No. 173.1 demonstrated pI values close to physiologic pH, which should not impact their useful activities although it could indicate potential suboptimal formulation stability.

TABLE 30

In Silico Analysis of Sequence Liabilities of anti-VISTA antibodies.

| | | | | TIER 1 | | | | TIER 2 | |
|---|---|---|---|---|---|---|---|---|---|
| | Covariance | | | | | | | | |
| Antibody No. | Metric | Violators | RTL Loss (RANDY) | Non Standard Cys | Cys Location | Disulfide | Non-Standard N-Link Glycosylation Site | Potential Deamidation Site (CDR) | HV: 108 Salt Bridge Disruption K/R to HV: D137 |
| 245.1 | 3 | 1 | 31 | 0 | | | 0 | 0 | 0 |
| 269.1 | 1 | 1 | 97 | 0 | | | 0 | 0 | 0 |
| 457.1 | 3 | 1 | 46 | 0 | | | 0 | 0 | 0 |
| 321.1 | 6 | 2 | 48 | 1 | HC-FR3, HV: C89 | N | 0 | 1 | 0 |
| 465.1 | 11 | 4 | 47 | 0 | | | 0 | 0 | 0 |
| 173.1 | 12 | 5 | 65 | 0 | | | 0 | 1 | 0 |

| | TIER 2 | | | | | | | | |
|---|---|---|---|---|---|---|---|---|---|
| | | | Patch | | | | Other | | |
| Antibody No. | Potential Isomerization Site (CDR) | Potential Trp Oxidation Site (CDR3) | Hydrophobic Area max | Negative Area max | Positive Area max | Physical Properties pI (Bjellqvist) | Expression (Tiller) | Immunogenicity (ANNergy) | Score (Low = Best) |
| 245.1 | 0 | 1 | 230 | 40 | 60 | 8.49 | 0.167 | 64.7 | 4 |
| 269.1 | 2 | 0 | 150 | 60 | 50 | 7.89 | n/a | 52.2 | 6 |
| 457.1 | 1 | 2 | 180 | 40 | 40 | 8.02 | n/a | 69 | 6 |
| 321.1 | 0 | 0 | 220 | 40 | 50 | 8.42 | n/a | 42.4 | 12 |
| 465.1 | 2 | 2 | 150 | 60 | 40 | 6.54 | 0.175 | 47.5 | 19.5 |
| 173.1 | 0 | 0 | 200 | 100 | 40 | 6.95 | 0.725 | 34 | 20 |

Example 20: In Vivo Functional Characterization of Anti-VISTA Antibody—MC38 Tumor Growth Inhibition in Single Agent or in Combination Therapy in VISTA-KI Mouse The objective of this study was to evaluate the in viva therapeutic efficacy of antibody No. 245.2 in the MC38 murine cancer model in KI-VISTA mice. Antibody No. 245.2 is a mouse IgG2a antibody.

MC38 tumor cells were cultured in vitro in DMEM supplemented with 10% fetal bovine serum at 37° C. in an atmosphere of 5% $CO_2$ in air. The cells were harvested in the exponential growth phase and quantified by cell counter before tumor inoculation. Each mouse was inoculated subcutaneously in the right rear flank region with MC38 tumor cells ($1\times10^6$) in 0.1 ml of PBS for tumor development. The date of tumor cell inoculation was denoted as day 0. Randomization occurred when the mean tumor size reached approximately 75 $mm^3$ (70-100 $mm^3$). Fifty six mice were enrolled in the study. All animals were randomly allocated to 7 study groups. After tumor cell inoculation, the animals were checked daily for morbidity and mortality. Tumor volumes were measured twice per week in two dimensions using a caliper, and the volume was expressed in $mm^3$ using the formula: "$V=(L\times W\times W)/2$," where V is tumor volume, L is tumor length (the longest tumor dimension) and W is tumor width (the longest tumor dimension perpendicular to L). Dosing as well as tumor and body weight measurements were conducted in a laminar flow cabinet. The body weights and tumor volumes were measured by using StudyDirector™ software (version 3.1.399.19). The study was terminated when the mean tumor volume of the vehicle treated control group reached 2000 $mm^3$ or one week following the final dose, whichever was first. To compare tumor volumes of different groups at a pre-specified day, Bartlett's test was used to check the assumption of homogeneity of variance across all groups. If the p-value of Bartlett's test was ≥0.05, a one-way ANOVA was run to test overall equality of means across all groups. If the p-value of the one-way ANOVA was <0.05, further post hoc testing was performed by running Tukey's HSD (honest significant difference) tests for all pairwise comparisons, and Dunnett's tests for comparing each treatment group with the vehicle group. If the p-value of Bartlett's test was <0.05, a Kruskal-Wallis test was run to test overall equality of medians among all groups. If the p-value of the Kruskal-Wallis test was <0.05, further post hoc testing was performed by running Conover's non-parametric test for all pairwise comparisons or for comparing each treatment group with the vehicle group, both with single-step p-value adjustment.

In addition, pairwise comparisons without multiple testing correction were performed and nominal/uncorrected p-values directly from Welch's t-test or Mann-Whitney U test were reported. Specifically, Bartlett's test was used first to check the assumption of homogeneity of variance for a pair of groups. If the p-value of Bartlett's test was ≥0.05, Welch's t-test was run to obtain nominal p-values, otherwise, a Mann-Whitney U test was run. All statistical analyses were done in R (version 3.3.1). All tests were two-sided unless otherwise specified, and p-values of <0.05 were regarded as statistically significant.

Antibody No. 245.2 inhibited MC38 tumor growth in the VISTA KI mouse model, and its efficacy was increased in combination with an anti-mPD1 antibody (FIG. 56A).

Example 21: In Vivo Functional Characterization of Anti-VISTA Mab—MB49 Tumor Growth Inhibition in Single Agent or Combo-Therapy in VISTA ECD KI Mice The objective of these studies was to evaluate the in vivo therapeutic efficacy of Ab No 474.1 (WT) or Ab No. 150.1 (YTE) in the treatment of the subcutaneous MB49 murine bladder cancer model in VISTA ECD KI mice. MB49 tumor cells were cultured in vitro with DMEM medium supplemented with 10% fetal bovine serum at 37° C. in 5% CO2. Cells in exponential growth phase were harvested and quantitated by cell counter before tumor inoculation. Each mouse was inoculated subcutaneously in the right rear flank region with MB49 tumor cells (5×105 cells per mouse) in 0.1 ml of PBS. The date of tumor cell inoculation was denoted as day 0. Mice were randomized into groups of 8 mice per group on day 5 when the mean tumor size reached approximately 75 mm3 (60-100 mm3). Mice were treated by intraperitoneal (IP) administration two times a week beginning on Day 5 for three weeks with 20 mg/kg of Ab No 474.1 or Ab No. 150.1, 20 mg/kg human IgG1, 5 mg/kg anti-mPD1, or a combo-therapy of Anti-VISTA Ab and anti-mPD1.

After tumor cell inoculation, the animals were checked daily for morbidity and mortality. During routine monitoring, animals were checked for any effects of tumor growth and treatments on behavior such as mobility, food and water consumption, and signs of discomfort. These signs include, but aren't limited to, labored respiration, hunched posture, poor grooming, and abnormal ambulation. Mortality and observed clinical signs were recorded for individual animals in detail. Body weights and tumor volumes were measured at least three times per week. Tumor volumes were measured in two dimensions using calipers and volumes were expressed in mm3 using the formula V=(L×W×W)/2, where V is tumor volume, L is tumor length (the longest tumor dimension), and W is tumor width (the longest tumor dimension perpendicular to L). Individual mice were euthanized once the tumor volume reached ≥2000 mm3 or ≥10% of the mouse's body weight, whichever was reached first, if the mouse lost ≥20% of their initial body weight, or if the body condition score reached a score of 1. Mice with ulcerated tumors were monitored daily and were euthanized if ulcers were open for 24 hours or immediately if tumors ≥1000 mm3 had open ulcers.

Ab No 474.1 or Ab No. 150.1 both strongly inhibit MB49 tumor growth in the VISTA KI mouse model as a single agent (FIG. 56B). The efficacy of Ab No. 150.1 is enhanced in combo-therapy, e.g., with anti-mPD1, in the VISTA KI mouse model (FIG. 56C).

Example 22: Phenotypical Characterization Immune Cells in MB49 Tumor Microenvironment of VISTA-KI Mouse Treated with Single Agent Anti-VISTA Mab or as Combo Therapy The phenotype of tumor infiltrating immune cells were analyzed by multi-parameter flow cytometry experiments. Tumor samples were harvested from 3 mice/group at day 13 (24 hours after 3rd dose) and single cell suspension was prepared using tumor dissociation kit, mouse from Miltenyi Biotech (CAT #130-096-730). Single cells suspension was prepared in Flow cytometer staining buffer (2% FBS/PBS+1 mM EDTA) to a final concentration of 50 million cells/mL. To stain cells for phenotypic analysis 50 uL of single cell suspension prepared from each of the tumor samples were added to 96-well u-bottom plate. The remaining samples were combined and used for FMO staining. Cells were spun at 400 g/5 mins and supernatant was discarded. 50 uL of Block buffer was added to each sample (1:50 dilution of BD mouse Fc block CAT #553141 in FCS buffer) and incubated on ice for 15 mins. Antibody cocktail is prepared based on the number of samples and each FMO cocktail was prepared by adding all antibodies in the full stain cocktail minus one fluorophore conjugated antibody. To cells staining in block buffer add 50 uL of antibody cocktail to each sample and FMO and incubate on ice for 30 mins. After incubation spin down cells at 400 g for 5 mins and discard supernatant. After surface staining, RBC's were lysed and samples were fixed with 100 uL of 1×1 step Lyse Fix buffer (ebiosciences CAT #00-5333-54) and incubate for 20 mins on ice. Wash cells twice with Flow Cytometry Staining Buffer. Resuspend cells in 125 uL Flow Cytometry Staining Buffer and run on Attune NXT flow cytometer.

The treatment of the MB49 bladder tumor by Ab No 150.1 induces an increase of intra-tumoral CD4+ and CD8+ T cells as well as NK cells. These T cells are mostly Effector Memory T cells. Besides, Ab No 150.1 treatment reduces the number of suppressive gMDSC into the tumor and converts M2 macrophages in M1. The combination of Ab No. 150.1 with an anti mPD1 further increases the frequency of intra-tumoral Effector Memory CD4+ T cells (FIGS. 56D-56L).

Example 23: In Vivo Pharmacokinetics Study to Assess Exposure Levels of Anti-hVISTA Antibodies in Human VISTA KI Mice This pharmacokinetics study was performed to assess exposure levels of anti-hVISTA antibodies in human VISTA KI mice after an intraperitoneal (IP) administration of 10, 30 or 100 mg/kg. Blood sampling was performed at 2, 4, 8, 24, 48 or 72-hour time points after administration.

A 10-point standard curve was first generated for each anti-VISTA antibody in 0.5% BSA-PBS and 0.1-10% mouse serum. Antibody No. 245.1 and Antibody No. 245.2 were diluted to 500 ng/mL in PBS and 2.4-fold dilutions were made for a final concentration range of 0.5 ng/mL-500 ng/mL in 0.1-10% mouse serum. A standard curve was generated on each plate and applied to the samples using a nonlinear regression with a sigmoidal dose-response (variable slope). Then, samples were diluted 1:10, 1:100, 1:1,000, 1:10,000, or 1:100,000 and analyzed by sandwich ELISA. The concentrations were determined from the standard curve in mouse serum. The positive OD cut point was calculated for each ELISA plate using the following equation to detect positive samples with a 95% confidence interval as per published guidance (A Fray et al. 1998. A statistically defined endpoint titer determination method for immunoassays. Journal of Immunological Methods 221, 35-41): Cut Point=Mean $OD_{450}$ of Background+(SD of $OD_{450}$ of Background×SD Multiplier). SD: Standard deviation; SD Multiplier: The standard deviation multiplier is dependent on the number of replicates: 3.372 was used as the multiplier for samples with 3 replicates.

used for determining positive samples for the standard curve and the cut point calculated for the pre-dose plasma sample was used for determining positive samples for each animal. For each standard curve concentration, the accuracy (% of nominal value) and precision (coefficient of variation; % CV) were calculated. The range of quantitation was determined by the following criteria:

The standard accuracy is ±20% of the nominal value (±25% at the lower limit of quantitation (LLOQ) and upper limit of quantitation (ULOQ)).

The standard precision is ±20% CV (±25% at the LLOQ and ULOQ).

The total error (accuracy+precision) does not exceed 30% (40% at the LLOQ and ULOQ).

75% of non-zero standards in the quantitation range meet the above criteria (including the LLOQ and ULOQ).

The LLOQ is above the cut point determined for the standard curve.

GraphPad Prism was used to determine the concentration value for each sample using a nonlinear regression with a sigmoidal dose-response (variable slope). For each sample, the plasma dilution that resulted in an $OD_{450}$ value closest to the $OD_{450}$ value of the $EC_{50}$ of the dose-response curve was used to determine the concentration for that time point. GraphPad Prism was used to determine the $EC_{50}$ of each standard curve. The $OD_{450}$ value of the $EC_{50}$ was calculated using the following equation:

$$OD_{450}=\text{Bottom of curve}+(\text{Top of curve}-\text{Bottom of curve})/[1+10^{(LogEC50-X)*HillSlope}].$$

TABLE 31

PK Parameters of anti-VISTA antibodies after an IP dose in human VISTA knock-in mice.

| Parameter | | Unit | Antibody No. 245.1 | Antibody No. 245.1 | Antibody No. 245.1 | Antibody No. 245.2 |
|---|---|---|---|---|---|---|
| Dose | D | Mg/kg | 10 | 30 | 100 | 10 |
| Peak plasma concentration | $C_{max}$ | ug/ml | 115 | 645 | 1514 | 116 |
| Last plasma concentration | $C_{last}$ | ug/ml | 24 | 6 | 156 | 0.03 |
| Time of peak plasma concentration | $T_{max}$ | hr | 4 | 4 | 4 | 8 |
| Time of last plasma concentration | $T_{last}$ | hr | 24 | 72 | 72 | 48 |
| Elimination half life | $T_{1/2}$ | hr | 9.4 | 9.6 | 33 | 3.4 |
| Area under the curve | $AUC_{0-t}$ | ug/ml * hr | 1,457 | 11,008 | 37,414 | 1,831 |
| AUC extrapolated to infinity | $AUC_{0-inf\ obs}$ | ug/ml * hr | 1777 | 11,098 | 44,849 | 1,832 |
| Ratio of AUC and AUC extrapolated to infinity | $AUC_{0-t/0-inf\ obs}$ | | 0.82 | 0.99 | 0.83 | 1 |
| Mean Residence Time | $MRT_{0-inf}$ | hr | 14.2 | 20.4 | 38.1 | 1.3 |
| Ratio of $C_{last}$ and $C_{max}$ | $C_{last}/C_{max}$ | | 0.0138 | 0.01 | 0.1033 | 0.0002 |
| Lag time | $T_{lag}$ | hr | 0 | 0 | 0 | 0 |
| Area under first moment of plasma concentration-time curve extrapolated to infinity | $AUMC_{0-inf\ obs}$ | ug/ml * hr ^ 2 | 25,264 | 225,870 | 1,706,517 | 20667 |
| Volume of distribution during terminal phase | $V_z$ | (mg/kg)/(ug/ml) | 0.076 | 0.037 | 0.106 | 0.027 |
| Clearance | Cl | (mg/kg)/(ug/ml)/h | 0.006 | 0.003 | 0.002 | 0.005 |
| Terminal disposition rate constant | Lambda_z | 1/hr | 0.074 | 0.073 | 0.021 | 0.204 |

NE: Not Estimated

The cut point was determined for the blank standard (0 ng/mL). The cut point calculated for the blank standard was After a 30 mg/kg IP administration of antibody No. 245.1 to female human VISTA KI mice, peak antibody No. 245.1 serum exposure was achieved 4 hours post-dose with a $C_{max}$ of 645 μg/mL, with exposure decreasing to 6 μg/mL at 72 hours post-dose. The AUC was 11,008 hr*μg/mL and the half-life was 9.6 hours. Compared to the 10 mg/kg and 100 mg/kg dose of antibody No. 245.1, there was a 7.6-fold increase in AUC as the dose increased from 10 mg/kg to 30 mg/kg and a 3.4-fold increase in AUC as the dose increased from 30 mg/kg to 100 mg/kg. The half-life for the 30 mg/kg dose (9.6 hours) was similar to the half-life for the 10 mg/kg dose (9.4 hours).

The pharmacokinetic profiles of antibody No. 245.1 (human IgG1) and antibody No. 245.2 (mouse IgG2a) were almost identical (FIGS. 57A and 57B).

Example 24: In Vivo Pharmacokinetics Study to Assess Exposure Levels of Anti-hVISTA Antibodies in Human VISTA KI Mice A pharmacokinetics study was performed to assess exposure levels of novel anti-hVISTA antibodies in human VISTA KI mice after an intraperitoneal (IP) administration of 10 mg/kg. Blood sampling was performed at 2, 4, 8, 12, 24, or 48-hour time points.

Another pharmacokinetics study was performed to assess exposure levels of novel anti-VISTA antibodies in human VISTA KI mice after repeated intraperitoneal (IP) administration of 10 mg/kg or 30 mg/kg. Mice were dosed every 48 hours for a total of 3 doses in the 10 mg/kg group and mice were dosed every 3-4 days for a total of 4 doses in the 30 mg/kg group. Blood sampling was performed at 4, 8, 12, 24, 48, 72 or 96-hour time points.

A 10-point standard curve was first generated for each anti-VISTA antibody in 0.5% BSA-PBS and 0.1-10% mouse serum. Ab No. 474.1, No. 150.1 and VSTB174 were diluted to 250 ng/mL in PBS and 2.4-fold dilutions were made for a final concentration range of 0.2 ng/mL-250 ng/mL in 0.1-10% mouse serum. A standard curve was generated on each plate and applied to the samples using a nonlinear regression with a sigmoidal dose-response (variable slope). Then, samples were diluted 1:10, 1:100, 1:1,000, 1:10,000, or 1:100,000 and analyzed by sandwich ELISA. The concentrations were determined from an anti-VISTA antibody standard curve in mouse serum as described above. The positive OD cut point was calculated for each ELISA plate using the equation below in order to detect positive samples with a 95% confidence interval as per published guidance (A Frey, et al.):

Cut Point=Mean OD450 of Background+(SD of OD450 of Background×SD Multiplier)

SD: Standard deviation

SD Multiplier: The standard deviation multiplier is dependent on the number replicates: 3.372 was used as the multiplier for samples with 3 replicates.

The cut point was determined for the blank standard (0 ng/mL). The cut point calculated for the blank standard was used for determining positive samples for the standard curve and unknown samples. For each standard curve concentration, the accuracy (% of nominal value) and precision (coefficient of variation; % CV) were calculated. The range of quantitation was determined by the following criteria:

1. The standard accuracy is ±20% of the nominal value (±25% at the LLOQ and ULOQ).
2. The standard precision is ±20% CV (±25% at the LLOQ and ULOQ).
3. The total error (accuracy+precision) does not exceed 30% (40% at the LLOQ and ULOQ).
4. 75% of non-zero standards in the quantitation range meet the above criteria (including the LLOQ and ULOQ).
5. The LLOQ is above the cut point determined for the standard curve.

GraphPad Prism was used to determine the concentration value for each sample using a nonlinear regression with a sigmoidal dose-response (variable slope). For each sample, the plasma dilution that resulted in an OD450 value closest to the OD450 value of the EC50 of the dose-response curve was used to determine the concentration for that time point (FIGS. 57C-57E and Tables 32 and 33). GraphPad Prism was used to determine the EC50 of each standard curve. The OD450 value of the EC50 was calculated using the following equation:

OD450=Bottom of curve+(Top of curve−Bottom of curve)/[1+10(LogEC50−X)*HillSlope)]

TABLE 32

PK parameters of anti-VISTA antibodies after a single 10 mg/kg IP dose in human female VISTA KI mice.

| Parameter | | Unit | Ab No. 474.1 | Ab No. 150.1 | VSTB174 |
|---|---|---|---|---|---|
| Peak plasma concentration | $C_{max}$ | ug/ml | 96 | 56 | 92 |
| Last plasma concentration | $C_{last}$ | ug/ml | 0.008 | 0.007 | 0.003 |
| Time of peak plasma concentration | $T_{max}$ | hr | 4 | 4 | 4 |
| Time of last plasma concentration | $T_{last}$ | hr | 24 | 24 | 24 |
| Elimination half life | $T_{1/2}$ | hr | 1.4 | 1.2 | 1.3 |
| Area under the curve | $AUC_{0-t}$ | ug/ml * hr | 975 | 680 | 1046 |
| AUC extrapolated to infinity | $AUC_{0-inf\ obs}$ | ug/ml * hr | 975 | 680 | 1046 |
| Ratio of AUC and AUC extrapolated to infinity | $AUC_{0-t/0-inf\ obs}$ | | 1.0 | 1.0 | 1.0 |

TABLE 32-continued

PK parameters of anti-VISTA antibodies after a single 10 mg/kg IP dose in human female VISTA KI mice.

| Parameter | | Unit | Ab No. 474.1 | Ab No. 150.1 | VSTB174 |
|---|---|---|---|---|---|
| Ratio of $C_{last}$ and $C_{max}$ | $C_{last}/C_{max}$ | | 0.00008 | 0.0001 | 0.0003 |
| Lag time | $T_{lag}$ | hr | 0 | 0 | 0 |
| Area under first moment of plasma concentration-time curve extrapolated to infinity | $AUMC_{0\text{-}inf\ obs}$ | ug/ml * hr ^ 2 | 7108 | 5144 | 6317 |
| Mean residence time | $MRT_{0\text{-}inf\ obs}$ | hr | 7.3 | 7.564 | 6 |
| Volume of distribution during terminal phase | $V_z$ | (mg/kg)/(ug/ml) | 0.021 | 0.025 | 0.018 |
| Clearance | Cl | (mg/kg)/(ug/ml)/h | 0.010 | 0.015 | 0.010 |
| Terminal disposition rate constant | Lambda_z | 1/hr | 0.491 | 0.585 | 0.544 |

NE: Not Estimated

After a 10 mg/kg IP administration of Ab No. 474.1 to female human VISTA KI mice, peak Ab No. 474.1 serum exposure was 2 hours post-dose with a Cmax of 96 ug/mL with exposure decreasing to 0.008 ug/mL at 24 hours post-dose ($T_{last}$). Serum exposure was BLQ at 48 hours post dose. The AUC was 975 hr*ug/mL and the half-life was 1.4 hours.

After a 10 mg/kg IP administration of Ab No. 150.1 to female human VISTA KI mice, peak Ab No. 150.1 serum exposure was 4 hours post-dose with a Cmax of 56 ug/mL with exposure decreasing to 0.007 ug/mL at 24 hours post-dose. Serum exposure was BLQ at 48 hours post dose. The AUC was 680 hr*ug/mL and the half-life was 1.2 hours.

After a 10 mg/kg IP administration of VSTB174 to female human VISTA KI mice, peak VSTB174 serum exposure was 4 hours post-dose with a Cmax of 92 ug/mL with exposure decreasing to 0.003 ug/L at 24 hours post-dose. Serum exposure was BLQ at 48 hours post dose. The AUC was 1046 hr*ug/mL and the half-life was 1.3 hours.

TABLE 33

PK parameters of Ab No. 150.1 after a single or repeated 10 mg/kg or 30 mg/kg IP dose in human VISTA KI mice.

| Parameter | | Unit | Ab No. 150.1 10 mg/kg Day 1 | Ab No. 150.1 10 mg/kg Day 5 | Ab No. 150.1 30 mg/kg Day 1 | Ab No. 150.1 30 mg/kg Day 11 |
|---|---|---|---|---|---|---|
| Peak plasma concentration | $C_{max}$ | ug/ml | 65 | 67 | 294 | 135 |
| Last plasma concentration | $C_{last}$ | ug/ml | 0.02 | 0.02 | 0.01 | 0.01 |
| Time of peak plasma concentration | $T_{max}$ | hr | 4 | 4 | 4 | 4 |
| Time of last plasma concentration | $T_{last}$ | hr | 24 | 24 | 48 | 48 |
| Elimination half life | $T_{1/2}$ | hr | 1.4 | 1.4 | 2.8 | 3.3 |
| Area under the curve | $AUC_{0\text{-}t}$ | ug/ml * h | 590 | 645 | 4327 | 902 |
| AUC extrapolated to infinity | $AUC_{0\text{-}inf\ obs}$ | ug/ml * hr | 589 | 645 | 4327 | 902 |
| Ratio of AUC and AUC extrapolated to infinity | $AUC_{0\text{-}t/0\text{-}inf\ obs}$ | | 1.0 | 1.0 | 1.0 | 1.0 |
| Ratio of $C_{last}$ and $C_{max}$ | $C_{last}/C_{max}$ | | 0.0003 | 0.0003 | 0.00004 | 0.00008 |
| Lag time | $T_{lag}$ | hr | 0 | 0 | 0 | 0 |
| Area under first moment of plasma concentration-time curve extrapolated to infinity | $AUMC_{0\text{-}inf\ obs}$ | ug/ml * hr ^ 2 | 4234 | 4933 | 49603 | 5618 |
| Mean residence time | $MRT_{0\text{-}inf\ obs}$ | hr | 7.183 | 7.643 | 11.463 | 6.227 |
| Volume of distribution during terminal phase | $V_z$ | (mg/kg)/(ug/ml) | 0.033 | 0.030 | 0.028 | 0.159 |
| Clearance | Cl | (mg/kg)/(ug/ml)/ | 0.017 | 0.015 | 0.007 | 0.033 |
| Terminal disposition rate constant | Lambda_z | 1/hr | 0.511 | 0.510 | 0.250 | 0.209 |

NE: Not Estimated

After a single 10 mg/kg IP administration of Ab No. 150.1 to female human VISTA KI mice, peak Ab No. 150.1 serum exposure was 4 hours post-dose with a Cmax of 65 ug/mL with exposure decreasing to 0.02 ug/mL at 24 hours post-dose. The AUC was 590 hr*ug/mL and the half-life was 1.4 hours. On Day 5, after three repeated 10 mg/kg IP administrations of Ab No. 150.1 every 48 hours in female human VISTA KI mice, Ab No. 150.1 serum exposure was similar to exposure observed after a single dose. Peak Ab No. 150.1 serum exposure was 4 hours post-dose with a Cmax of 67 ug/mL (1× of Day 1 Cmax) with exposure decreasing to 0.02 ug/mL at 24 hours post-dose. The AUC was 645 hr*ug/mL (1.1× of Day 1 AUC) and the half-life was 1.4 hours.

After a single 30 mg/kg IP administration of Ab No. 150.1 to female human VISTA KI mice, peak Ab No. 150.1 serum exposure was 4 hours post-dose with a Cmax of 294 ug/mL with exposure decreasing to 0.01 ug/mL at 48 hours post-dose. The AUC was 4327 hr*ug/mL and the half-life was 2.8 hours. On Day 11, after four repeated 30 mg/kg IP administrations of Ab No. 150.1 every 3-4 days in female human VISTA KI, mice peak Ab No. 150.1 serum exposure was 4 hours post-dose with a Cmax of 135 ug/mL (0.5× of Day 1 Cmax) with exposure decreasing to 0.01 ug/mL at 48 hours post-dose. The AUC was 902 hr*ug/mL (0.2× of Day 1 AUC) and the half-life was 3.3 hours.

Example 25: In Vivo Pharmacokinetics Study to Assess Exposure Levels of Anti-hVISTA Antibody Ab No. 150.1 in Cynomolgus Monkeys A pharmacokinetics study was performed to assess exposure levels of novel anti-hVISTA antibody in cynomolgus monkeys after a single 30 mg/kg intravenous (IV) dose, after three daily 10 mg/kg IV doses, and after five 5 mg/kg IV doses every two days in male and female cynomolgus monkeys. Blood sampling was performed at 0.083, 24, 72, 120, 168, 216, 240, or 264-hour time points following the 30 mg/kg and 10 mg/kg doses and at 0.083, 24, 48, 72, or 120-hour time points following the 5 mg/kg doses.

A toxicokinetics study was also performed to assess exposure levels of novel anti-VISTA antibody in cynomolgus monkeys after repeated intravenous (IV) administration of 10 mg/kg, 30 mg/kg, or 100 mg/kg. Monkeys were dosed every 7 days for a total of 4 doses. Blood sampling was performed at 0.083, 6, 24, 48, 72 or 168-hour time points after the first and fourth dose.

A 10-point standard curve was first generated for each Ab in 0.5% BSA-PBS and 0.01-10% cynomolgus monkey serum. Ab No. 150.1 were diluted to 250 ng/mL in PBS and 2.4-fold dilutions were made for a final concentration range of 0.2 ng/mL-250 ng/mL in 0.01-10% monkey serum. A standard curve was generated on each plate and applied to the samples using a nonlinear regression with a sigmoidal dose-response (variable slope). Then samples were diluted 1:10, 1:100, 1:1,000, 1:10,000, or 1:100,000 and analyzed by sandwich ELISA. The concentrations were determined from an antibody standard curve in monkey serum as described above. The positive OD cut point was calculated for each ELISA plate using the equation below in order to detect positive samples with a 95% confidence interval as per published guidance (A Frey, et al.):

Cut Point=Mean $OD_{450}$ of Background+(SD of $OD_{450}$ of Background×SD Multiplier)

SD: Standard deviation

SD Multiplier: The standard deviation multiplier is dependent on the number replicates: 3.372 was used as the multiplier for samples with 3 replicates.

The cut point was determined for the blank standard (0 ng/mL) as well as the animal's prebleed serum sample. The cut point calculated for the blank standard was used for determining positive samples for the standard curve and the cut point calculated for the prebleed plasma sample was used for determining positive samples for that animal. For each standard curve concentration, the accuracy (% of nominal value) and precision (coefficient of variation; % CV) were calculated. The range of quantitation was determined by the following criteria:

1. The standard accuracy is ±20% of the nominal value (±25% at the LLOQ and ULOQ).
2. The standard precision is ±20% CV (±25% at the LLOQ and ULOQ).
3. The total error (accuracy+precision) does not exceed 30% (40% at the LLOQ and ULOQ).
4. 75% of non-zero standards in the quantitation range meet the above criteria (including the LLOQ and ULOQ).
5. The LLOQ is above the cut point determined for the standard curve.

GraphPad Prism was used to determine the concentration value for each sample using a nonlinear regression with a sigmoidal dose-response (variable slope). For each sample, the plasma dilution that resulted in an $OD_{450}$ value closest to the $OD_{450}$ value of the $EC_{50}$ of the dose-response curve was used to determine the concentration for that time point. GraphPad Prism was used to determine the $EC_{50}$ of each standard curve. The $OD_{450}$ value of the $EC_{50}$ was calculated using the following equation:

$$OD_{450}=\text{Bottom of curve}+(\text{Top of curve}-\text{Bottom of curve})/[1+10^{(LogEC50-X)*HillSlope}]$$

TABLE 34

Pharmacokinetic parameters of Ab No. 150.1 after a single 30 mg/kg IV dose, after three daily 10 mg/kg IV doses, or after five 5 mg/kg IV doses every two days in male and female cynomolgus monkeys.

| Parameter | | Unit | 30 mg/kg Male Day 1 | 30 mg/kg Female Day 1 | 10 mg/kg Male Day 3 | 30 mg/kg Female Day 3 | 5 mg/kg Female Day 9 |
|---|---|---|---|---|---|---|---|
| Peak plasma concentration | $C_{max}$ | ug/ml | 1032 | 987 | 624 | 647 | 222 |
| Last plasma concentration | $C_{last}$ | ug/ml | 40 | 0.04 | 5 | 0.01 | 6 |
| Time of peak plasma concentration | $T_{max}$ | hr | 0.083 | 0.083 | 0.083 | 0.083 | 0.083 |
| Time of last plasma concentration | $T_{last}$ | hr | 264 | 264 | 264 | 264 | 120 |

TABLE 34-continued

Pharmacokinetic parameters of Ab No. 150.1 after a single 30 mg/kg IV dose, after three daily 10 mg/kg IV doses, or after five 5 mg/kg IV doses every two days in male and female cynomolgus monkeys.

| Parameter | | Unit | 30 mg/kg Male Day 1 | 30 mg/kg Female Day 1 | 10 mg/kg Male Day 3 | 30 mg/kg Female Day 3 | 5 mg/kg Female Day 9 |
|---|---|---|---|---|---|---|---|
| Elimination half life | $T_{1/2}$ | hr | 65 | 10 | 22 | 9 | 24 |
| Area under the curve | $AUC_{0-t}$ | ug/ml * hr | 71811 | 45742 | 51617 | 36735 | 7470 |
| AUC extrapolated to infinity | $AUC_{0-inf\ obs}$ | ug/ml * hr | 75544 | 45743 | 51770 | 36736 | 7667 |
| Ratio of AUC and AUC extrapolated to infinity | $AUC_{0-t/0-inf\ obs}$ | | 1.0 | 1.0 | 1.0 | 1.0 | 1.0 |
| Ratio of $C_{last}$ and $C_{max}$ | $C_{last}/C_{max}$ | | 0.039 | 0.00004 | 0.008 | 0.00002 | 0.026 |
| Extrapolated initial concentration at time zero | C0 | ug/ml | 1034 | 990 | 624 | 648 | 223 |
| Area under first moment of plasma concentration-time curve extrapolated to infinity | $AUMC_{0-inf\ obs}$ | ug/ml * hr ^ 2 | 6788819 | 2052022 | 3304481 | 1497318 | 225910 |
| Mean residence time | $MRT_{0-inf\ obs}$ | hr | 90 | 45 | 64 | 41 | 29 |
| Volume of distribution during terminal phase | $V_z$ | (mg/kg)/(ug/ml) | 0.037 | 0.009 | 0.006 | 0.004 | 0.022 |
| Clearance | Cl | (mg/kg)/(ug/ml)/h | 0.0004 | 0.001 | 0.0002 | 0.0003 | 0.0007 |
| Terminal disposition rate constant | Lambda_z | 1/hr | 0.011 | 0.073 | 0.031 | 0.075 | 0.029 |

NE: Not Estimated

After a single 30 mg/kg IV administration of Ab No. 150.1 to a male cynomolgus monkey, peak Ab No. 150.1 serum exposure was 0.083 hours post-dose with a Cmax of 1032 ug/mL with exposure decreasing to 40 ug/mL at 264 hours post-dose. The AUC was 71811 hr*ug/mL and the half-life was 65 hours. After a single 30 mg/kg IV administration of Ab No. 150.1 to a female cynomolgus monkey, peak Ab No. 150.1 serum exposure was 0.083 hours post-dose with a Cmax of 987 ug/mL with exposure decreasing to 0.04 ug/mL at 264 hours post-dose. The AUC was 45742 hr*ug/mL and the half-life was 10 hours.

After three daily 10 mg/kg IV administrations of Ab No. 150.1 to a male cynomolgus monkey, peak Ab No. 150.1 serum exposure was 0.083 hours post-dose with a Cmax of 624 ug/mL with exposure decreasing to 5 ug/mL at 264 hours post-dose. The AUC was 51617 hr*ug/mL and the half-life was 22 hours. After a three daily 10 mg/kg IV administration of Ab No. 150.1 to a female cynomolgus monkey, peak Ab No. 150.1 serum exposure was 0.083 hours post-dose with a Cmax of 647 ug/mL with exposure decreasing to 0.01 ug/mL at 264 hours post-dose. The AUC was 36735 hr*ug/mL and the half-life was 9 hours.

After five 5 mg/kg IV administrations every two days of Ab No. 150.1 to a female cynomolgus monkey, peak Ab No. 150.1 serum exposure was 0.083 hours post-dose with a Cmax of 222 ug/mL with exposure decreasing to 6 ug/mL at 120 hours post-dose. The AUC was 7470 hr*ug/mL and the half-life was 24 hours.

TABLE 35

Toxicokinetic parameters of Ab No. 150.1 after a single or repeated 10 mg/kg, 30 mg/kg, or 100 mg/kg IV dose in male and female cynomolgus monkeys.

| Parameter | | Unit | 10 mg/kg Day 1 | 10 mg/kg Day 22 | 30 mg/kg Day 1 | 30 mg/kg Day 22 | 100 mg/kg Day 1 | 100 mg/kg Day 22 |
|---|---|---|---|---|---|---|---|---|
| Peak plasma concentration | $C_{max}$ | ug/ml | 320 | 291 | 900 | 885 | 2261 | 3498 |
| Last plasma concentration | $C_{last}$ | ug/ml | 18 | 0.3 | 66 | 6 | 820 | 1427 |
| Time of peak plasma concentration | $T_{max}$ | hr | 0.083 | 0.083 | 0.083 | 0.083 | 0.083 | 0.083 |
| Time of last plasma concentration | $T_{last}$ | hr | 168 | 168 | 168 | 168 | 168 | 168 |

TABLE 35-continued

Toxicokinetic parameters of Ab No. 150.1 after a single or repeated 10 mg/kg, 30 mg/kg, or 100 mg/kg IV dose in male and female cynomolgus monkeys.

| Parameter | | Unit | 10 mg/kg Day 1 | 10 mg/kg Day 22 | 30 mg/kg Day 1 | 30 mg/kg Day 22 | 100 mg/kg Day 1 | 100 mg/kg Day 22 |
|---|---|---|---|---|---|---|---|---|
| Elimination half life | $T_{1/2}$ | hr | 47 | 19 | 50 | 44 | 118 | 121 |
| Area under the curve | $AUC_{0-t}$ | ug/ml * hr | 16955 | 3493 | 54708 | 18924 | 184167 | 317489 |
| AUC extrapolated to infinity | $AUC_{0-inf\ obs}$ | ug/ml * hr | 18185 | 3501 | 59438 | 19322 | 323934 | 566580 |
| Ratio of AUC and AUC extrapolated to infinity | $AUC_{0-t/0-inf\ obs}$ | | 0.9 | 1.0 | 0.9 | 1.0 | 0.6 | 0.6 |
| Ratio of $C_{last}$ and $C_{max}$ | $C_{last}/C_{max}$ | | 0.057 | 0.001 | 0.073 | 0.007 | 0.363 | 0.408 |
| Extrapolated initial concentration at time zero | C0 | ug/ml | 321 | 296 | 902 | 891 | 2263 | 3505 |
| Area under first moment of plasma concentration-time curve extrapolated to infinity | $AUMC_{0-inf\ obs}$ | ug/ml * hr ^ 2 | 1198046 | 72253 | 4107340 | 510808 | 60274567 | 106980046 |
| Mean residence time | $MRT_{0-inf\ obs}$ | hr | 66 | 21 | 69 | 26 | 186 | 189 |
| Volume of distribution during terminal phase | $V_z$ | (mg/kg)/(ug/ml) | 0.037 | 0.080 | 0.036 | 0.098 | 0.053 | 0.031 |
| Clearance | Cl | (mg/kg)/(ug/ml)/h | 0.001 | 0.003 | 0.001 | 0.002 | 0.0003 | 0.0002 |
| Terminal dispo-sition rate constant | Lambda_z | 1/hr | 0.015 | 0.036 | 0.014 | 0.016 | 0.006 | 0.033 |

NE: Not Estimated

After a single 10 mg/kg IV administration of Ab No. 150.1 to cynomolgus monkeys, peak Ab No. 150.1 serum exposure was 0.083 hours post-dose with a Cmax of 320 ug/mL with exposure decreasing to 18 ug/mL at 168 hours post-dose. The AUC was 16955 hr*ug/mL and the half-life was 47 hours. On Day 22, after four weekly 10 mg/kg IV administrations of Ab No. 150.1 in cynomolgus monkeys, peak Ab No. 150.1 serum exposure was 0.083 hours post-dose with a Cmax of 291 ug/mL (0.9× of Day 1 Cmax) with exposure decreasing to 0.3 ug/mL at 168 hours post-dose. The AUC was 3493 hr*ug/mL (0.2× of Day 1 AUC) and the half-life was 19 hours.

After a single 30 mg/kg IV administration of Ab No. 150.1 to cynomolgus monkeys, peak Ab No. 150.1 serum exposure was 0.083 hours post-dose with a Cmax of 900 ug/mL with exposure decreasing to 66 ug/mL at 168 hours post-dose. The AUC was 54708 hr*ug/mL and the half-life was 50 hours. On Day 22, after four weekly 30 mg/kg IV administrations of Ab No. 150.1 cynomolgus monkeys, peak Ab No. 150.1 serum exposure was 0.083 hours post-dose with a Cmax of 885 ug/mL (1× of Day 1 Cmax) with exposure decreasing to 6 ug/mL at 168 hours post-dose. The AUC was 18924 hr*ug/mL (0.3× of Day 1 AUC) and the half-life was 44 hours.

After a single 100 mg/kg IV administration of Ab No. 150.1 to cynomolgus monkeys, peak Ab No. 150.1 serum exposure was 0.083 hours post-dose with a Cmax of 2261 ug/mL with exposure decreasing to 820 ug/mL at 168 hours post-dose. The AUC was 184167 hr*ug/mL and the half-life was 118 hours. On Day 22, after four weekly 100 mg/kg IV administrations of Ab No. 150.1 cynomolgus monkeys, peak Ab No. 150.1 serum exposure was 0.083 hours post-dose with a Cmax of 3498 ug/mL (1.5× of Day 1 Cmax) with exposure decreasing to 1427 ug/mL at 168 hours post-dose. The AUC was 317489 hr*ug/mL (1.7× of Day 1 AUC) and the half-life was 121 hours.

In addition to these in vivo pharmacokinetic studies, clinical observations, hematology, clinical chemistry and immunogenicity were monitored. No overt clinical signs or loss of weight were observed, no-treatment-related findings for clinical pathology endpoints were detected, no change of cytokine levels involved in a Cytokine Release Syndrome, in particular IL6 and TNFα were observed. In summary, even at high repeated dose (100 mg/kg), antibody No. 150.1 demonstrated exceptional tolerability associated with an extended PK.

Example 26: In Vivo Toxicokinetics Study to Assess the Relationship of Serum Exposure Levels and Monocyte Receptor Occupancy of Anti-hVISTA Antibody Ab No. 150.1 in Cynomolgus Monkeys A toxicokinetics study was also performed to assess the relationship of serum exposure levels and monocyte receptor occupancy of novel anti-VISTA antibody in cynomolgus monkeys after repeated intravenous (IV) administration of 10 mg/kg, 30 mg/kg, or 100 mg/kg. Monkeys were dosed every 7 days for a total of 4 doses. Blood sampling for serum exposure measurement was performed at 0.083, 6, 24, 48, 72 or 168-hour time points after the first and fourth dose. These data are reported in Table 36. Blood sampling for receptor occupancy measurement was performed at 6, 72 or 168-hour time points after the first and fourth dose.

Cell samples were frozen on day of blood draw. Samples from all timepoints were thawed, stained, and analyzed on the same day for flow cytometric measurement of anti- VISTA-AlexaFluor 647 Median Fluorescence Intensity of viable, singlet, CD45+, CD14+, HLA-DR+ cells in Free, Background, Bound, and Total assays. Free and Background assay samples were incubated for ½ hour with staining buffer or 1000 ug/mL of test article antibody No. 150.1, respectively, prior to addition of the staining cocktail containing anti-CD45-PE, anti-CD14-Brilliant Violet 421, anti-HLA-DR-AlexaFluor488, and Fixable Live/Dead Lime Viability Dye, and Ab No. 150.1-AlexaFluor647. Samples were fixed by the addition of fix/lyse solution. Bound and Total assay samples were incubated for 1 hour with staining buffer or 80 ug/mL of test article antibody Ab No. 150.1, respectively, then washed two times. Then the samples were incubated with a staining cocktail containing anti-CD45-PE, anti-CD14-Brilliant Violet 421, anti-HLA-DR-AlexaFluor488, Fixable Live/Dead Lime Viability Dye, and goat-anti-human IgG (NHP-adsorbed)-AlexaFluor647. Samples were washed one time, then fixed by the addition of fix/lyse solution. Study samples, QC samples, bead compensation samples, and AlexaFluor647 MESF bead samples were acquired on an Attune Nxt acoustic cytometer. .fcs files of acquired samples were compensated and analyzed in Flowjo software. Anti-VISTA-AlexaFluor 647 Median Fluorescence Intensity of viable, singlet, CD45+, CD14+, HLA-DR+ cells was quantitated and converted to standardized units of AlexaFluor647 fluorescence intensity by application of Quantum AlexaFluor647 MESF Beads and QuickCal v2.3 quantitative software. These values were input to the calculations below to generate % Free Receptor (Equation 1), % Bound Receptor (Equation 2), and Weighted % Receptor Occupancy (Equation 3) values. Equation 2 values which exceeded 100% were converted to 100% and input to Equation 3. Data were analyzed in Microsoft Excel (365 for Business) and graphed in GraphPad Prism (v8). Weighted % Receptor Occupancy values were reported as "% Receptor Occupancy" in figures and tables.

$$\%\ \text{Free VISTA}=100*(\text{Free}_{Timepoint}-\text{Background}_{Timepoint})/(\text{Free}_{Predose}-\text{Background}_{Predose}) \quad \text{Eq. 1}$$

$$\%\ \text{Bound VISTA}=100*(\text{Bound}_{Timepoint}-\text{Bound}_{Predose})/(\text{Total}_{Timepoint}-\text{Bound}_{Predose}) \quad \text{Eq. 2}$$

$$\text{Weighted}\ \%\ \text{RO}=100*(100-\%\ \text{Free})/((100-\%\ \text{Free})+(100-\%\ \text{Bound})) \quad \text{Eq. 3}$$

TABLE 36

Comparison of serum exposure levels and monocyte receptor occupancy of anti-hVISTA antibody Ab No. 150.1 in cynomolgus monkeys after a single or repeated 10 mg/kg, 30 mg/kg, or 100 mg/kg IV dose male and female cynomolgus monkeys.

| | 10 mg/kg Group Mean of An. 2001, 2601 | | | | 30 mg/kg Group Mean of An. 3001, 3501 | | | | 100 mg/kg Group Mean of An. 4001, 4501 | | | |
|---|---|---|---|---|---|---|---|---|---|---|---|---|
| Time (hours) | Day 1 Serum Exposure (ug/mL) | Day 1 % RO | Day 22 Serum Exposure (ug/mL) | Day 22 % RO | Day 1 Serum Exposure (ug/mL) | Day 1 Weighted % RO | Day 22 Serum Exposure (ug/mL) | Day 22 Weighted % RO | Day 1 Serum Exposure (ug/mL) | Day 1 Weighted % RO | Day 22 Serum Exposure (ug/mL) | Day 22 Weighted % RO |
| 0 | 0.0 | 0.0 | 1.1 | | 0.0 | 0.0 | 10.0 | | 0.0 | 0.0 | 1230.6 | |
| 0.083 | 319.9 | | 290.6 | | 899.6 | | 885.4 | | 2260.9 | | 3498.5 | |
| 6 | 251.2 | 104.9 | 76.2 | 99.8 | 739.2 | 95.0 | 555.8 | 97.7 | 2110.6 | 93.0 | 3046.7 | 99.0 |
| 24 | 160.7 | | 38.0 | | 527.7 | | 226.4 | | 1394.8 | | 2911.4 | |
| 72 | 77.6 | 123.7 | 8.6 | 23.8 | 286.2 | 111.9 | 28.7 | 60.0 | 851.1 | 99.6 | 1498.5 | 94.4 |
| 120 | 73.2 | | 0.7 | | 216.6 | | 13.0 | | 947.8 | | 1422.1 | |
| 168 | 18.3 | 95.8 | 0.1 | 0.0 | 66.0 | 92.4 | 6.3 | 10.2 | 819.7 | 97.1 | 1426.9 | 97.1 |
| | An. 2001 (M) | | | | An. 3001 (M) | | | | An. 4001 (M) | | | |
| Time (hours) | Day 1 Serum Exposure (ug/mL) | Day 1 % RO | Day 22 Serum Exposure (ug/mL) | Day 22 % RO | Day 1 Serum Exposure (ug/mL) | Day 1 Weighted % RO | Day 22 Serum Exposure (ug/mL) | Day 22 Weighted % RO | Day 1 Serum Exposure (ug/mL) | Day 1 Weighted % RO | Day 22 Serum Exposure (ug/mL) | Day 22 Weighted % RO |
| 0 | 0.0 | 0.0 | 0.2 | | 0.0 | 0.0 | 11.0 | | 0.0 | 0.0 | 1077.9 | |
| 0.083 | 347.4 | | 292.7 | | 884.5 | | 996.8 | | 2389.4 | | 3582.0 | |
| 6 | 251.8 | 96.5 | 95.2 | 99.9 | 812.9 | 100.0 | 624.1 | 100 | 2145.7 | 97.2 | 3291.0 | 100.0 |
| 24 | 185.3 | | 42.9 | | 533.7 | | 319.0 | | 1450.1 | | 2998.7 | |
| 72 | 96.0 | 100.0 | 6.1 | 14.1 | 269.3 | 100.0 | 42.5 | 75.43237 | 780.9 | 99.1 | 1525.2 | 93.4 |
| 120 | 123.2 | | 0.3 | | 210.4 | | 20.2 | | 927.2 | | 1497.8 | |
| 168 | 34.0 | 100.0 | 0.0 | 0.0 | 4.1 | 89.9 | 11.9 | 12.79414 | 865.6 | 95.6 | 1460.8 | 100.0 |
| | An. 2601 (F) | | | | An. 3501 (F) | | | | An. 4501 (F) | | | |
| Time (hours) | Day 1 Serum Exposure (ug/mL) | Day 1 % RO | Day 22 Serum Exposure (ug/mL) | Day 22 % RO | Day 1 Serum Exposure (ug/mL) | Day 1 Weighted % RO | Day 22 Serum Exposure (ug/mL) | Day 22 Weighted % RO | Day 1 Serum Exposure (ug/mL) | Day 1 Weighted % RO | Day 22 Serum Exposure (ug/mL) | Day 22 Weighted % RO |
| 0 | 0.0 | 0.0 | 1.9 | | 0.0 | 0.0 | 9.0 | | 0.0 | 0.0 | 1383.4 | |
| 0.083 | 292.5 | | 288.5 | | 914.7 | | 774.0 | | 2132.5 | | 3415.0 | |
| 6 | 250.6 | 100.0 | 57.3 | 99.7 | 665.5 | 89.7 | 487.5 | 89.8 | 2075.5 | 88.9 | 2802.3 | 98.0 |
| 24 | 136.1 | | 33.1 | | 521.7 | | 133.7 | | 1339.4 | | 2824.1 | |
| 72 | 59.2 | 100.0 | 11.1 | 33.4 | 303.1 | 100.0 | 14.8 | 39.6 | 921.4 | 100.0 | 1471.8 | 95.4 |
| 120 | 23.2 | | 1.1 | | 222.7 | | 5.8 | | 968.4 | | 1346.3 | |
| 168 | 2.6 | 81.1 | 0.3 | | 127.9 | 94.8 | 0.7 | 11.0 | 773.8 | 98.6 | 1393.0 | 94.2 |

Average VISTA receptor occupancy levels of 10, 30, and 100 mg/kg Ab No. 150.1-dosed groups were maintained at >90% during the week following the first dose by in vivo exposure levels >18, 66, and 820 ug/nl in the 10, 30, and 100 mg/kg groups, respectively. One animal in each of the 10 and 30 mg/kg dose groups exhibited accelerated beta phase clearance from 120 to 168 hours following the first dose, with moderate decrease of serum exposure and receptor occupancy. By contrast, both animals exhibited sustained high exposure and receptor occupancy throughout 168 hours following the first dose. High receptor occupancy levels continued to be sustained by high exposure levels in the 100 mg/kg dosed animals following the fourth dose. By contrast receptor occupancy decreased rapidly in parallel to exposure levels in both animals of the 30 and 10 mg/kg groups following the fourth dose. This can probably be explained by the development of ADA. See FIGS. 57F-57N.

Example 27: In Vivo Functional Characterization of Anti-VISTA Mab Immune Activation in Cynomolgus Monkey The ability of antibody No. 173.1, antibody No. 173.4, antibody No. 289.1 and antibody No. 420.1 antibodies to modulate myeloid cell activation markers in the peripheral blood of cynomolgus monkeys following a single and repeat intravenous administration at 10 mg/kg was evaluated according to the following methods:

The animals were fasted prior to dosing for concurrent (predose) clinical pathology sample collections. Each animal received a single intravenous (IV) dose of the appropriate test antibody. Treatments on Days 1 and 8 are as outlined in Table 37. Intravenous doses were administered via the cephalic/saphenous (or other suitable) vein. The doses were administered as a slow injection over at least 2 minutes, with all blood collection times calculated from the end of dosing.

TABLE 37

| Group | Test Anti-body | Number of Females | Dose Route | Vehicle | Dose Level (mg/kg) | Dose Volume (mL/kg) | Collec-tion Intervals |
|---|---|---|---|---|---|---|---|
| 1 | 173.1 | 1 | IV | a | 10 | 5 | Blood[b] |
| 2 | 289.1 | 1 | IV | a | 10 | 5 | Blood[b] |
| 3 | 420.1 | 1 | IV | a | 10 | 5 | Blood[b] |
| 4 | 173.4 | 1 | IV | a | 10 | 5 | Blood[b] |

a Sterile PBS, pH 7.2

[b]Blood samples were collected on Days 1 and 8 predose and at 5 and 30 minutes, and 4, 8, 24, 72, 96 and 168 hours postdose. The 168-hour postdose sample on Day 1 was collected prior to dosing on Day 8.

Myeloid cell populations and the expression of activation markers were evaluated by ex vivo flow cytometry analysis. Cell samples were frozen on day of blood draw and stored until analysis. Samples from all time points pre- and post-dose were thawed, stained, and analyzed on the same day for measurements of myeloid population size and activation markers. Samples were gated for singlets, viable cells, and CD45+ cells. Myeloid cells were identified from the CD45+ population as CD66−CD3−CD8−CD20−, side scatter intermediate cells. Monocytes were identified from the myeloid population as CD14+ cells. A CD14-HLA-DR+ population was identified from analysis of the myeloid cells. Myeloid DC (mDC) were identified as CD1c+ and/or CD11c+ CD123− cells from the CD14−HLA-DR+ population.

Changes of activation markers in mDC and in CD14+ populations following in vivo exposure to anti-VISTA antibodies were determined. FIGS. 58A-58X show % change in MFI relative to pre-dose as identified by ex vivo flow cytometry analysis. Myeloid DC (mDC) were identified by a gating analysis of CD45+ cells. Mean fluorescence intensity of CD80, CD86, and HLA-DR of mDC were acquired on technical duplicates, and MFI from FMO samples were subtracted. Percentage change in MFI relative to pre-dose levels was calculated as follows: % Change=100*($MFI_{Dx}$−$MFI_{D0}$)/$MFI_{D0}$.

Myeloid activation markers were upregulated on both mDC and monocytes (CD14+ cells) by anti-VISTA antibodies. Antibody No. 173.1 strongly upregulated activation markers CD80 and CD86 and modestly upregulated HLA-DR on mDC at 72 hours post-dose after both doses. Antibody No. 173.4 upregulated CD86 and HLA-DR modestly on mDC following the first dose. Antibody No. 173.1 strongly upregulated activation markers CD80 and CD86 on CD14+ cells at 72 hours post-dose for both doses. Antibody No. 173.4 upregulated CD80 and CD86 modestly on CD14+ cells. Relative to antibody No. 173.1 (WT), antibody No. 289.1 (LS mutation) enhanced CD80 expression on both mDC and monocytes (CD14+ cells) while reducing (in mDC) or eliminating (in monocytes) the CD86 induction. The oscillatory rhythm of CD80 and CD86 induction is consistent with the pharmacokinetic profiles of the anti-VISTA antibodies described herein, and this rhythm was much more pronounced with the mutant antibodies than with the WT antibodies. These patterns were very similar between mDC and CD14+ populations. CD80 and CD86 results with antibody No. 420.1 (YTE mutation) were most similar to those with antibody No. 173.4 (WT), but modestly more pronounced (CD80 more induced; CD86 more decreased from baseline). Modest HLA-DR inductions by WT on mDC and HLA-DR was slightly reduced by LS and YTE (FIGS. 58A-58X).

Example 28: Anti-Tumor Activity of Anti-VISTA Antibodies in the MB49 Bladder Cancer Model VISTA human knock-in mice (16-19 weeks old) were inoculated with 50 μL containing $5\times10^5$ MB49 cells in PBS to the right flank on Day 0. Mice were monitored for tumor growth and randomized to treatment arms when mean tumor volumes reached approximately 70 $mm^3$ (n=10-11 animals per group). Animals received twice weekly injections of 30 mg/kg mouse IgG2a control antibody (Bio XCell, clone C1.18.4), antibody No. 245.2 or antibody No. 245.2 L234A, L235A (LALA) beginning on Day 5 for a total of six doses. Tumor volumes were measured every 2-3 days by caliper. Animals were euthanized on Day 24, two days after the final study dose, and tumor, blood and draining lymph nodes were collected. Mean tumor volume in each group on Day 24: IgG2a (1522 $mm^3$), 245.2 (511 $mm^3$), and 245.2 LALA (1112 $mm^3$) (FIGS. 59A-59D). Anti-VISTA antibody treatment resulted in 66% and 27% tumor growth inhibition for 245.2 and 245.2 LALA, respectively. The mutant Fc anti-VISTA antibody had reduced potency relative to the wild-type anti-VISTA IgG2a antibody in the MB49 model.

Example 29: Phenotypical Characterization of Immune Cells in MB49 Tumor Microenvironment of VISTA-KI Mouse Treated with Single Agent Anti-VISTA Mab or as Combo Therapy The phenotype of tumor infiltrating immune cells were analyzed by multi-parameter flow cytometry experiments. Tumor samples were harvested from 3 mice/group at day 24

(3 days after 6 doses) and single cell suspension was prepared using tumor dissociation kit, mouse from Miltenyi Biotech (CAT #130-096-730). Single cells suspension was prepared in Flow cytometer staining buffer (2% FBS/PBS+1 mM EDTA) to a final concentration of 50 million cells/mL. To stain cells for phenotypic analysis 50 uL of single cell suspension prepared from each of the tumor samples were added to 96-well u-bottom plate. The remaining samples were combined and used for FMO staining. Cells were spun at 400 g/5 mins and supernatant was discarded. 50 uL of Block buffer was added to each sample (1:50 dilution of BD mouse Fc block CAT #553141 in FCS buffer) and incubated on ice for 15 mins. Antibody cocktail is prepared based on the number of samples and each FMO cocktail was prepared by adding all antibodies in the full stain cocktail: minus one fluorophore conjugated antibody. To cells staining in block buffer add 50 uL of antibody cocktail to each sample and FMO and incubate on ice for 30 mins. After incubation spin down cells at 400 g for 5 mins and discard supernatant. After surface staining, RBC's were lysed with 200 uL of 1×RBC lysis buffer (Biolegend CAT #420301) and incubate for 10 mins at room temperature. After incubation spin down cells at 400 g for 5 mins and discard supernatant. After surface staining, RBC's were lysed and samples were fixed with 100 uL of 1×1 step Lyse Fix buffer (ebiosciences CAT #00-5333-54) and incubate for 20 mins on ice. Wash cells twice with Flow Cytometry Staining Buffer. Resuspend cells in 125 uL Flow Cytometry Staining Buffer and un on Attune NXT flow cytometer.

The treatment of the MB49 bladder tumor by Ab No 245.2 (Mse IgG2a backbone) induces an increase of intra-tumoral CD3+ T cells which are mostly CD4+ as well as NK cells, while the Ab No. 245.2 with a LALA mutation does not increase the frequency of infiltrating T cells into the tumor. Besides, Ab No 245.2 treatment reduces the frequency of suppressive gMDSC into the tumor. See FIGS. 59E-59H.

Example 30: Anti-Tumor Activity of Anti-VISTA Antibodies in e.g7-OVA Thymoma Model VISTA human knock-in mice (16-18 weeks old) were inoculated with 100 μL containing 1×10$^6$ E.G7-OVA cells in PBS to the right flank on Day 0. Mice were monitored for tumor growth and randomized to treatment arms when mean tumor volumes reached approximately 70 mm$^3$ (n=11-12 animals per group). Animals received twice weekly injections of 30 mg/kg mouse IgG2a control antibody (Bio XCell, clone C1.18.4), antibody No. 245.2 or antibody No. 245.2 L234A, L235A (LALA) beginning on Day 7 for a total of six doses. Tumor volumes were measured every 2-3 days by caliper. Animals were euthanized on Day 27, two days after the final study dose, and tumor, blood and draining lymph nodes were collected. Mean tumor volume in each group on Day 27: IgG2a (1692 mm$^3$), 245.2 (594 mm$^3$), and 245.2 LALA (716 mm$^3$) (FIG. 60A-60D). Anti-VISTA antibody treatment resulted in 65% and 58% tumor growth inhibition for 245.2 and 245.2 LALA, respectively. The mutant Fc anti-VISTA antibody had approximately equal potency relative to the wild-type anti-VISTA IgG2a antibody in the E.G7-OVA model. Treatment with antibody No. 245.2 and antibody 245.2 LALA resulted in complete tumor regression in 3 and 3 animals, respectively.

Example 31: Histidine Substitutions in the Heavy and Light Chain of Antibody No. 245.1 and 474.1 that Increase Off-Rate from VISTA-ECD at pH 6.0 vs pH 7.4

Histidine switches were designed in CDRs 1 to 3 of both the heavy and light chains of antibody No. 245.1 and antibody No. 474.1 by targeting tyrosine, aspartic acid, glutamic acid and asparagine residues. The light chain Y31H and light chain Y32H single amino acid substitutions, according to the EU numbering system, were made on the Antibody No. 245.1 background. All other single and multiple substitutions were made on the Antibody No. 474.1 background.

Antibodies containing the histidine substitutions were expressed in Expi293 cells and purified with mAbSelect SuRe protein A resin. Kinetics of the antibody-target binding was evaluated using Anti-Human Fc (AHC) biosensors (ForteBio 18-5060) and the Octet K2, running two sensors in parallel. Antibody mutants were diluted to 20 ug/mL in 1×PBS pH7.4 (GE SH30028.02) and loaded onto the AHC biosensors for 120 seconds. After a 160 second wash in 1×PBS, the loaded biosensors were dipped into 50 nM VISTA-His ECD (Sino Biological 13482-H08H) analyte for the 240 second association step. The parallel biosensors were then dipped in 1×PBS for the 360 second dissociation step where one PBS sample is pH 7.4 and the other is pH 6.0 (adjusted with M HCl). Data analysis was performed using Octet Data Analysis software version 9.0.0.14. Baseline alignment without subtraction was used for raw data processing, and a Savitzky-Golay digital filter was used to remove high-frequency noise. Processed data were globally fit to a 1:1 binding model and Ka (1/ms) and Kdis (1/s) were determined. The effects of a single histidine substitution on antibody affinity at pH 6.0 are shown in Table 38 (where "Loading Sample ID" is the Antibody No.). The following antibodies had Ka and Kds similar to wild-type at pH 7.4, but the dissociation rate was increased at pH 6.0 relative to pH 7.4 by 4 to 6-fold: Antibody Nos. 373.1, 467.1, 338.1, 277.1 and 419.1. Mutations are numbered according to the EU numbering system. "VH" represents a mutation in the variable heavy sequence. "VL" represents a mutation in the variable light sequence. Antibody No. 245.1 was used as the unmodified control antibody in this analysis and contains no histidine substitutions in its CDRs. Combinations of one or more histidine switches were made to Antibody No. 474.1 and evaluated as above for Kds on the VISTA-ECD at pH 6.0 versus pH 7.4. The results are given in Table 39. Mutations are numbered according to the EU numbering system. "VH" represents a mutation in the variable heavy sequence. "VL" represents a mutation in the variable light sequence. Antibody No. 245.1 was used as the unmodified control antibody in this analysis. These antibody substitutions, alone or in combination, are expected to increase endosomal dissociation of antibody from the VISTA receptor. The results in Table 39 show that combinations of two or more histidine substitutions can increase dissociation of the antibody from VISTA at pH 6.0.

TABLE 38

Effect of single histidine substitutions on antibody dissociation at pH 6.0.

| Sample ID | Conc. (nM) | Loading Sample ID | Loading Conc. (μg/ml) | Dissociation pH | KD (M) | ka (1/Ms) | kdis (1/s) | Mutation | Ratio to WT | Ratio to WT |
|---|---|---|---|---|---|---|---|---|---|---|
| VISTA-His | 50 | 245.1 | 20 | 7.4 | 1.78E−10 | 5.18E+05 | 9.20E−05 | WT | 1.0 | 1.0 |
| VISTA-His | 50 | 245.1 | 20 | 6.0 | 6.00E−10 | 5.17E+05 | 3.10E−04 | | 1.0 | 1.0 |
| VISTA-His | 50 | 373.1 | 20 | 7.4 | 9.55E−10 | 4.25E+05 | 4.05E−04 | VL | 0.8 | 4.4 |
| VISTA-His | 50 | 373.1 | 20 | 6.0 | 1.52E−08 | 3.61E+05 | 5.48E−03 | Y31H | 0.7 | 17.7 |
| VISTA-His | 50 | 467.1 | 20 | 7.4 | 9.81E−10 | 5.22E+05 | 5.12E−04 | VL | 1.0 | 5.6 |
| VISTA-His | 50 | 467.1 | 20 | 6.0 | 2.10E−08 | 4.05E+05 | 8.49E−03 | Y32H | 0.8 | 27.4 |
| VISTA-His | 50 | 908.1 | 20 | 7.4 | 2.41E−05 | 1.10E+04 | 2.65E−01 | VL | 0.0 | 2881.4 |
| VISTA-His | 50 | 908.1 | 20 | 6.0 | 1.00E−07 | 1.00E+04 | 1.00E−03 | D50H | 0.0 | 3.2 |
| VISTA-His | 50 | 386.1 | 20 | 7.4 | 5.65E−09 | 5.21E+05 | 2.95E−03 | VL | 1.0 | 32.0 |
| VISTA-His | 50 | 386.1 | 20 | 6.0 | 1.19E−05 | 3.35E+03 | 3.99E−02 | N53H | 0.0 | 128.6 |
| VISTA-His | 50 | 268.1 | 20 | 7.4 | 3.31E−09 | 6.50E+05 | 2.15E−03 | VL | 1.3 | 23.3 |
| VISTA-His | 50 | 268.1 | 20 | 6.0 | 7.61E−08 | 2.63E+05 | 2.00E−02 | Q89H | 0.5 | 64.5 |
| VISTA-His | 50 | 342.1 | 20 | 7.4 | 1.33E−10 | 5.56E+05 | 7.38E−05 | VL | 1.1 | 0.8 |
| VISTA-His | 50 | 342.1 | 20 | 6.0 | 8.03E−10 | 5.76E+05 | 4.63E−04 | Q90H | 1.1 | 1.5 |
| VISTA-His | 50 | 259.1 | 20 | 7.4 | 2.23E−11 | 5.84E+05 | 1.30E−05 | VL | 1.1 | 0.1 |
| VISTA-His | 50 | 259.1 | 20 | 6.0 | 3.67E−10 | 6.02E+05 | 2.21E−04 | N93H | 1.2 | 0.7 |
| VISTA-His | 50 | 338.1 | 20 | 7.4 | 1.62E−10 | 4.91E+05 | 7.93E−05 | VH | 0.9 | 0.9 |
| VISTA-His | 50 | 338.1 | 20 | 6.0 | 2.24E−09 | 4.88E+05 | 1.09E−03 | Y32H | 0.9 | 3.5 |
| VISTA-His | 50 | 419.1 | 20 | 7.4 | 5.01E−10 | 3.21E+05 | 1.60E−04 | VH | 0.6 | 1.7 |
| VISTA-His | 50 | 419.1 | 20 | 6.0 | 1.14E−08 | 2.99E+05 | 3.39E−03 | Y33H | 0.6 | 10.9 |
| VISTA-His | 50 | 277.1 | 20 | 7.4 | 1.24E−09 | 3.72E+05 | 4.62E−04 | VH | 0.7 | 5.0 |
| VISTA-His | 50 | 277.1 | 20 | 6.0 | 6.71E−09 | 3.67E+05 | 2.46E−03 | Y50H | 0.7 | 7.9 |
| VISTA-His | 50 | 946.1 | 20 | 7.4 | 4.19E−10 | 4.66E+05 | 1.95E−04 | VH | 0.9 | 2.1 |
| VISTA-His | 50 | 946.1 | 20 | 6.0 | 5.13E−09 | 4.65E+05 | 2.38E−03 | Y52H | 0.9 | 7.7 |
| VISTA-His | 50 | 322.1 | 20 | 7.4 | 1.57E−10 | 5.13E+05 | 8.04E−05 | VH | 1.0 | 0.9 |
| VISTA-His | 50 | 322.1 | 20 | 6.0 | 6.65E−10 | 5.00E+05 | 3.33E−04 | Y53H | 1.0 | 1.1 |
| VISTA-His | 50 | 346.1 | 20 | 7.4 | 2.64E−12 | 4.11E+05 | 1.08E−06 | VH | 0.8 | 0.0 |
| VISTA-His | 50 | 346.1 | 20 | 6.0 | 4.23E−11 | 4.28E+05 | 1.81E−05 | N58H | 0.8 | 0.1 |
| VISTA-His | 50 | 304.1 | 20 | 7.4 | 3.29E−10 | 3.60E+05 | 1.19E−04 | VH | 0.7 | 1.3 |
| VISTA-His | 50 | 304.1 | 20 | 6.0 | 9.86E−10 | 3.78E+05 | 3.73E−04 | Y59H | 0.7 | 1.2 |
| VISTA-His | 50 | 814.1 | 20 | 7.4 | 1.77E−10 | 4.78E+05 | 8.46E−05 | VH | 0.9 | 0.9 |
| VISTA-His | 50 | 814.1 | 20 | 6.0 | 4.28E−10 | 5.04E+05 | 2.16E−04 | N60H | 1.0 | 0.7 |
| VISTA-His | 50 | 210.1 | 20 | 7.4 | 5.93E−09 | 5.81E+05 | 3.45E−03 | VH | 1.1 | 37.5 |
| VISTA-His | 50 | 210.1 | 20 | 6.0 | 6.77E−09 | 5.03E+05 | 3.41E−03 | D95H | 1.0 | 11.0 |
| VISTA-His | 50 | 460.1 | 20 | 7.4 | 7.27E−10 | 3.46E+05 | 2.51E−04 | VH | 0.7 | 2.7 |
| VISTA-His | 50 | 460.1 | 20 | 6.0 | 2.69E−09 | 3.41E+05 | 9.16E−04 | D101H | 0.7 | 3.0 |

TABLE 39

Combination of two or more histidine substitutions on anti-VISTk$_{dis}$ A antibody dissociation at pH 6.0.

| His Switch Combinations | k$_{dis}$ pH 7.4 (×10$^{-5}$) | k$_{dis}$ pH 6.0 (×10$^{-4}$) | K$_{dis}$ (pH 7.4) ÷ K$_{dis}$, Ab No. 245.1 (pH 7.4) | K$_{dis}$ (pH 6.0) ÷ K$_{dis}$, Ab No. 245.1 (pH 6.0) | ΔK$_{dis}$ (pH 6.0)/ ΔK$_{dis}$ (pH 7.4) |
|---|---|---|---|---|---|
| Control (Antibody No. 245.1) | 9 | 3 | 1 | 1 | |
| VL Y31H, VH Y32H | 103 | 198 | 12 | 66 | 5.8 |
| VL Y31H, VH Y52H | 598 | 347 | 67 | 116 | 1.8 |
| VL Y31H, VH Y52H | 329 | 411 | 37 | 137 | 3.8 |
| VL Y32H, VH Y32H | 128 | 251 | 15 | 84 | 5.9 |
| VL Y32H, VH Y33H | 467 | 416 | 52 | 139 | 2.7 |
| VL Y32H, VH Y52H | 402 | 444 | 45 | 148 | 3.4 |
| VL Y31H, VL Y32H | 485 | 416 | 54 | 139 | 2.6 |
| VH Y32H, VH Y33H | 29 | 66 | 4 | 22 | 6.9 |
| VH Y32H, VH Y52H | 38 | 42 | 5 | 14 | 3.4 |

TABLE 39-continued

Combination of two or more histidine substitutions on anti-VISTk$_{dis}$ A antibody dissociation at pH 6.0.

| His Switch Combinations | k$_{dis}$ pH 7.4 (×10$^{-5}$) | k$_{dis}$ pH 6.0 (×10$^{-4}$) | K$_{dis}$ (pH 7.4) ÷ K$_{dis}$, Ab No. 245.1 (pH 7.4) | K$_{dis}$ (pH 6.0) ÷ K$_{dis}$, Ab No. 245.1 (pH 6.0) | ΔK$_{dis}$ (pH 6.0)/ ΔK$_{dis}$ (pH 7.4) |
|---|---|---|---|---|---|
| VH Y33H, VH Y52H | 118 | 206 | 14 | 69 | 5.3 |
| VH Y32H, VH Y33H, VH Y52H | 126 | 217 | 14 | 73 | 5.2 |
| VL Y31H, VH Y32H, VH Y33H | 612 | 289 | 68 | 97 | 1.5 |
| VL Y32H, VH Y32H, VH Y33H | 497 | 383 | 56 | 128 | 2.4 |
| VL Y31H, VH Y32H, VHY52H | 541 | 360 | 61 | 120 | 2 |
| VL Y32H, VH Y32H, VH Y52H | 638 | 370 | 71 | 124 | 1.8 |

Example 32: a Phase 1/2 Oven Label Trial of Anti-VISTA Antibodies in Patients with Advanced Solid Tumor The safety and efficacy of anti-VISTA antibodies, alone and in combination with pembrolizumab, are evaluated in a Phase 1/2 clinical trial in patients with advanced solid tumors.

The study is conducted in four parts. Part A consists of dose escalation with anti-VISTA monoclonal immunoglobulin antibody administered as a single agent in subjects with advanced tumors. Part B consists of dose escalation with the anti-VISTA monoclonal immunoglobulin antibody in combination with a fixed dose (200 mg once every 3 weeks (Q3W)) of pembrolizumab. Dose escalation in Parts A and B proceeds in parallel. The study population of Parts A and B consists of up to 6 subjects per dose level with a 0.3 to 0.5 log increase in dose of anti-VISTA antibody between dose levels up to a maximum dose of 1 g. The treatment begins with a starting dose in the range of 0.1 to 1 mg of the anti-VISTA antibody, which is then increased up to a maximum dose in the range of 200 mg to 1 g. The time to an increase in dose depends on the response of the patient to a given dose. Anti-VISTA antibody will be administered by slow IV infusion Q3W. Anti-VISTA antibody and pembrolizumab are administered on the same day, with pembrolizumab administered first by intravenous infusion over 30 minutes. Up to 60 subjects are treated in each dose escalation cohort.

Parts C and D are initiated once a maximum tolerated dose (MTD) has been defined in their respective dose escalation groups (Part A is the dose escalation group preceding Part C and Part B is the dose escalation group preceding Part D).

Cohort expansions are conducted with the anti-VISTA antibody as a monotherapy (Part C) and in combination with pembrolizumab (Part D), with the anti-VISTA antibody being given at the MTD defined in the respective dose escalation group. In Part C, the anti-VISTA monotherapy is administered to patients with non-small cell lung cancer (NSCLC) or squamous cell carcinoma of the head and neck (SCCHN) with recurrent or progressive disease who have failed previous chemotherapy (or chemoradiation therapy), and anti-PD-1 (or anti-PD-L1 therapy), e.g., the cancer is resistant to chemotherapy or chemoradiation therapy and anti-PD-1 or anti-PD-L1 therapy. Approximately 25 subjects are treated in each tumor group, for a total of 50 treated subjects in Part C.

In Part D, the anti-VISTA antibody in combination with pembrolizumab is administered to the following disease-restricted patient populations: patients with (i) NSCLC, (ii) SCCHN, (iii) hepatocellular carcinoma (HCC), (iv) ovarian cancer and (v) cervical cancer, respectively. Approximately 25 subjects are treated in each tumor group for a total of 125 subjects in Part D.

Enrolled subjects in each arm are eligible to receive up to four, 12-week cycles of study drug (the anti-VISTA antibody) (total of 16 doses) at the MTD defined in the respective dose escalation group.

Additional inclusion criteria for subjects in Part A and Part B: (1) subjects have histologically or cytologically confirmed solid malignancy (excluding primary tumors of the central nervous system) that is advanced (metastatic or unresectable) and incurable with existing therapies; and (2) subjects have progressed after, or been intolerant to, at least one standard treatment regimen in the advanced or metastatic setting.

Additional inclusion criteria for subjects in Part C and Part D is as follows. Subjects meet one of the following tumor-specific criteria: For NSCLC, subjects must have non-squamous histology with progressive or recurrent disease and have failed prior chemotherapy (carboplatin/paclitaxel or carboplatin/premetrexed) and anti-PD-1 or anti-PD-L1 therapy, e.g., the cancer is resistant to chemotherapy (carboplatin/paclitaxel or carboplatin/premetrexed) and anti-PD-1 or anti-PD-L1 therapy. NSCLC subjects with an EGFR mutation must have failed prior EGFR tyrosine kinase inhibitor therapy, e.g., the cancer is resistant to EGFR tyrosine kinase inhibitor therapy. Subjects with an ALK translocation must have failed prior ALK inhibitor therapy, e.g., the cancer is resistant to ALK inhibitor therapy.

For SCCHN, subjects must have histologically confirmed incurable, locally advanced, recurrent or metastatic SCCHN. SCCHN subjects must have failed a prior platinum-containing regimen (e.g., the cancer is resistant to a platinum containing regimen) and must not be a candidate for radiation therapy or surgical intervention with curative intent.

For HCC, subjects must have progressive disease and failed prior sorafenib therapy (e.g., the cancer is resistant to sorafenib) with Child-Pugh Score <6 in the absence of encephalopathy and clinically significant esophageal varices.

For cervical cancer, subjects must have recurrent or metastatic disease of squamous, adenosquamous, or adenocarcinoma histology and failed previous platinum-based therapy (e.g., the cancer is resistant to platinum-based therapy). Ovarian cancer patients must have histologically confirmed epithelial ovarian cancer with documented disease progression, having failed prior carboplatin/paclitaxel or other standard platinum-containing systemic therapy, e.g., the cancer is resistant to carboplatin/paclitaxel or other standard platinum-containing systemic therapy.

The invention is not to be limited in scope by the specific embodiments described herein. Indeed, various modifications of the invention in addition to those described will become apparent to those skilled in the art from the foregoing description and accompanying figures. Such modifications are intended to fall within the scope of the appended claims.

All references (e.g., publications or patents or patent applications) cited herein are incorporated herein by reference in their entirety and for all purposes to the same extent as if each individual reference (e.g., publication or patent or patent application) was specifically and individually indicated to be incorporated by reference in its entirety for all purposes.

SEQUENCE LISTING (654 sequences)

SEQ ID NO: 1-83 - skipped (83 entries)

SEQ ID NO: 84 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQTFGQGTKVEIK

SEQ ID NO: 85 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 86 - protein, 107 aa, Artificial Sequence
  Description of Artificial Sequence: Synthetic polypeptide
EIVLTQSPATLSLSPGERATLSCRASQSVSYYLAWYQQKPGQAPRLLIYDAFNRATGIPARFSGSGSGTDFTLTISSLEPEDFAVYYCQQRINWPLTFGGGTKVEIK

SEQ ID NO: 87 - protein, 107 aa, Artificial Sequence
  Description of Artificial Sequence: Synthetic polypeptide
DIQMTQSPSSLSASVGDRVTITCQASQDISNYLNWYQQKPGRAPELLIYDASNLETGVPSRFSGSGSGTDFTFTISSLQPEDFATYSCQQHDHLPWTFGQGTKVEIK

SEQ ID NO: 88 - protein, 107 aa, Artificial Sequence
  Description of Artificial Sequence: Synthetic polypeptide
EIVLTQSPATLSLSPGERATLSCGASQSVSSNYLAWYQQKPGLAPRLLIYGASSRATGVPDRFSGSGSGTDFTLTISRLEPEDFAVYYCQQYGYSYTFGQGTKLEIK

SEQ ID NO: 89 - protein, 106 aa, Artificial Sequence
  Description of Artificial Sequence: Synthetic polypeptide
DIQMTQSPSSLSASVGDRVTITCQASQDITNYLTWYQQKPGNAPKLLIYDASNLETGVPSRFSGSGSGTDFTFTINSLQPEDVATYFCQQYDNLPTFGGGTKVEIK

SEQ ID NO: 90 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAAAYYCHQRSSLPQTFGQGTKLEIK

SEQ ID NO: 91 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAAAYYCHQSSCLPQTFGQGTKVEIK

SEQ ID NO: 92 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAAAYYCHQSSSFPQTFGQGTKVEIK

SEQ ID NO: 93 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPHTFGQGTKLEIK

SEQ ID NO: 94 - protein, 107 aa, Artificial Sequence
  Description of Artificial Sequence: Synthetic polypeptide
EIVLTQSPDFQSVTPKEKVTITCRASQSIGTSLHWYQQKPDQSPKLLIKYASQSFSGVPSRFSGSGSGTDFTLTINSLEAEDAATYYCHQSSSLPLTFGGGTKVEIK

SEQ ID NO: 95 - protein, 107 aa, Artificial Sequence
  Description of Artificial Sequence: Synthetic polypeptide
EIVLTQSPDFQSVTPKEKVTITCRASQSIGSSLQWYQQKPDQSPKLLIKYASQSFSGVPSRFSGSGSGTDFTLTINSLEAEDAATYYCHQSSSLPPTFGGGTKVEIK

SEQ ID NO: 96 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQKFGQGTKVEIK

SEQ ID NO: 97 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQPFGQGTKVEIK

SEQ ID NO: 98 - protein, 107 aa, Artificial Sequence
  Description of Artificial Sequence: Synthetic polypeptide
EIVLTQSPATLSLSPGERATLSCRASQSVSYYLAWYQQKPGQAPRLLIYDAFNRATGIPARFSGSGSGTDFTLTISSLEPEDFAVYYCQQRINWPLPFGGGTKVEIK

SEQ ID NO: 99 - protein, 107 aa, Artificial Sequence
  Description of Artificial Sequence: Synthetic polypeptide
EIVLTQSPATLSLSPGERATLSCRASQSVNYYLAWYQQKPGQAPRLLIYDAFNRATGIPARFSGSGSGTDFTLTISSLEPEDFAVYYCQQRISWPLTFGGGTKVEIK

SEQ ID NO: 100 - protein, 107 aa, Artificial Sequence
  Description of Artificial Sequence: Synthetic polypeptide
EIVLTQSPATLSLSPGERATLSCRASQSVSHYLAWYQQKPGQAPRLLIYDAFNRATGIPARFSGSGSGTDFTLTISSLEPEDFAVYYCQQRINWPLTFGGGTKVEIK

SEQ ID NO: 101 - protein, 107 aa, Artificial Sequence
  Description of Artificial Sequence: Synthetic polypeptide
EIVLTQSPATLSLSPGERATLSCRASQSVSYHLAWYQQKPGQAPRLLIYDAFNRATGIPARFSGSGSGTDFTLTISSLEPEDFAVYYCQQRINWPLTFGGGTKVEIK

SEQ ID NO: 102 - protein, 107 aa, Artificial Sequence
  Description of Artificial Sequence: Synthetic polypeptide
EIVLTQSPATLSLSPGERATLSCRASQSVSYYLAWYQQKPGQAPRLLIYHAFNRATGIPARFSGSGSGTDFTLTISSLEPEDFAVYYCQQRINWPLTFGGGTKVEIK

SEQ ID NO: 103 - protein, 107 aa, Artificial Sequence
  Description of Artificial Sequence: Synthetic polypeptide
EIVLTQSPATLSLSPGERATLSCRASQSVSYYLAWYQQKPGQAPRLLIYDAFHRATGIPARFSGSGSGTDFTLTISSLEPEDFAVYYCQQRINWPLTFGGGTKVEIK

SEQ ID NO: 104 - protein, 107 aa, Artificial Sequence
  Description of Artificial Sequence: Synthetic polypeptide
EIVLTQSPATLSLSPGERATLSCRASQSVSYYLAWYQQKPGQAPRLLIYDAFNRATGIPARFSGSGSGTDFTLTISSLEPEDFAVYYCHQRINWPLTFGGGTKVEIK

SEQ ID NO: 105 - protein, 107 aa, Artificial Sequence
  Description of Artificial Sequence: Synthetic polypeptide
EIVLTQSPATLSLSPGERATLSCRASQSVSYYLAWYQQKPGQAPRLLIYDAFNRATGIPARFSGSGSGTDFTLTISSLEPEDFAVYYCQHRINWPLTFGGGTKVEIK

SEQ ID NO: 106 - protein, 107 aa, Artificial Sequence
  Description of Artificial Sequence: Synthetic polypeptide
EIVLTQSPATLSLSPGERATLSCRASQSVSYYLAWYQQKPGQAPRLLIYDAFNRATGIPARFSGSGSGTDFTLTISSLEPEDFAVYYCQQRIHWPLTFGGGTKVEIK

SEQ ID NO: 107 - protein, 106 aa, Artificial Sequence
  Description of Artificial Sequence: Synthetic polypeptide
DIQMTQSPSSLSASVGDRVTITCQASQHITNYLTWYQQKPGNAPKLLIYDASNLETGVPSRFSGSGSGTDFTFTINSLQPEDVATYFCQQYDNLPTFGGGTKVEIK

SEQ ID NO: 108 - protein, 106 aa, Artificial Sequence
  Description of Artificial Sequence: Synthetic polypeptide
DIQMTQSPSSLSASVGDRVTITCQASQDITNYLTWYQQKPGNAPKLLIYHASNLETGVPSRFSGSGSGTDFTFTINSLQPEDVATYFCQQYDNLPTFGGGTKVEIK

SEQ ID NO: 109 - protein, 106 aa, Artificial Sequence
  Description of Artificial Sequence: Synthetic polypeptide
DIQMTQSPSSLSASVGDRVTITCQASQDITNYLTWYQQKPGNAPKLLIYDASNLETGVPSRFSGSGSGTDFTFTINSLQPEDVATYFCQQYHNLPTFGGGTKVEIK

SEQ ID NO: 110 - protein, 106 aa, Artificial Sequence
  Description of Artificial Sequence: Synthetic polypeptide
DIQMTQSPSSLSASVGDRVTITCQASQDITNYLTWYQQKPGNAPKLLIYDASNLHTGVPSRFSGSGSGTDFTFTINSLQPEDVATYFCQQYDNLPTFGGGTKVEIK

SEQ ID NO: 111 - protein, 11 aa, Artificial Sequence
  Description of Artificial Sequence: Synthetic peptide
RASQSIGSSLH

SEQ ID NO: 112 - protein, 11 aa, Artificial Sequence
  Description of Artificial Sequence: Synthetic peptide
RASQGISSWLA

SEQ ID NO: 113 - protein, 11 aa, Artificial Sequence
  Description of Artificial Sequence: Synthetic peptide
RASQSVSYYLA

SEQ ID NO: 114 - protein, 11 aa, Artificial Sequence
  Description of Artificial Sequence: Synthetic peptide
QASQDISNYLN

SEQ ID NO: 115 - protein, 12 aa, Artificial Sequence
  Description of Artificial Sequence: Synthetic peptide
GASQSVSSNYLA

SEQ ID NO: 116 - protein, 11 aa, Artificial Sequence
  Description of Artificial Sequence: Synthetic peptide
QASQDITNYLT

SEQ ID NO: 117 - protein, 11 aa, Artificial Sequence
  Description of Artificial Sequence: Synthetic peptide
RASQSIGTSLH

SEQ ID NO: 118 - protein, 11 aa, Artificial Sequence
  Description of Artificial Sequence: Synthetic peptide
RASQSIGSSLQ

SEQ ID NO: 119 - protein, 11 aa, Artificial Sequence
  Description of Artificial Sequence: Synthetic peptide
RASQSVNYYLA

SEQ ID NO: 120 - protein, 11 aa, Artificial Sequence
  Description of Artificial Sequence: Synthetic peptide
RASQSVSHYLA

SEQ ID NO: 121 - protein, 11 aa, Artificial Sequence
  Description of Artificial Sequence: Synthetic peptide
RASQSVSYHLA

SEQ ID NO: 122 - protein, 11 aa, Artificial Sequence
  Description of Artificial Sequence: Synthetic peptide
QASQHITNYLT

SEQ ID NO: 123 - protein, 7 aa, Artificial Sequence
  Description of Artificial Sequence: Synthetic peptide
YASQSIS

SEQ ID NO: 124 - protein, 7 aa, Artificial Sequence
  Description of Artificial Sequence: Synthetic peptide
AASSLQS

SEQ ID NO: 125 - protein, 7 aa, Artificial Sequence
  Description of Artificial Sequence: Synthetic peptide
DAFNRAT

SEQ ID NO: 126 - protein, 7 aa, Artificial Sequence
  Description of Artificial Sequence: Synthetic peptide
DASNLET

SEQ ID NO: 127 - protein, 7 aa, Artificial Sequence
  Description of Artificial Sequence: Synthetic peptide
GASSRAT

SEQ ID NO: 128 - protein, 7 aa, Artificial Sequence
  Description of Artificial Sequence: Synthetic peptide
HAFNRAT

SEQ ID NO: 129 - protein, 7 aa, Artificial Sequence
  Description of Artificial Sequence: Synthetic peptide
DAFHRAT

SEQ ID NO: 130 - protein, 7 aa, Artificial Sequence
  Description of Artificial Sequence: Synthetic peptide
HASNLET

SEQ ID NO: 131 - protein, 7 aa, Artificial Sequence
  Description of Artificial Sequence: Synthetic peptide
DASNLHT

SEQ ID NO: 132 - protein, 9 aa, Artificial Sequence
  Description of Artificial Sequence: Synthetic peptide
HQSSSLPQT

SEQ ID NO: 133 - protein, 9 aa, Artificial Sequence
  Description of Artificial Sequence: Synthetic peptide
QQYNSYPYT

SEQ ID NO: 134 - protein, 9 aa, Artificial Sequence
  Description of Artificial Sequence: Synthetic peptide
QQRINWPLT

SEQ ID NO: 135 - protein, 9 aa, Artificial Sequence
  Description of Artificial Sequence: Synthetic peptide
QQHDHLPWT

SEQ ID NO: 136 - protein, 8 aa, Artificial Sequence
  Description of Artificial Sequence: Synthetic peptide
QQYGYSYT

SEQ ID NO: 137 - protein, 8 aa, Artificial Sequence
  Description of Artificial Sequence: Synthetic peptide
QQYDNLPT

SEQ ID NO: 138 - protein, 9 aa, Artificial Sequence
  Description of Artificial Sequence: Synthetic peptide
HQRSSLPQT

SEQ ID NO: 139 - protein, 9 aa, Artificial Sequence
  Description of Artificial Sequence: Synthetic peptide
HQSSCLPQT

SEQ ID NO: 140 - protein, 9 aa, Artificial Sequence
  Description of Artificial Sequence: Synthetic peptide
HQSSSFPQT

SEQ ID NO: 141 - protein, 9 aa, Artificial Sequence
  Description of Artificial Sequence: Synthetic peptide
HQSSSLPHT

SEQ ID NO: 142 - protein, 9 aa, Artificial Sequence
  Description of Artificial Sequence: Synthetic peptide
HQSSSLPLT

SEQ ID NO: 143 - protein, 9 aa, Artificial Sequence
  Description of Artificial Sequence: Synthetic peptide
HQSSSLPPT

SEQ ID NO: 144 - protein, 9 aa, Artificial Sequence
  Description of Artificial Sequence: Synthetic peptide
HQSSSLPQK

SEQ ID NO: 145 - protein, 9 aa, Artificial Sequence
  Description of Artificial Sequence: Synthetic peptide
HQSSSLPQP

SEQ ID NO: 146 - protein, 9 aa, Artificial Sequence
  Description of Artificial Sequence: Synthetic peptide
QQRINWPLP

SEQ ID NO: 147 - protein, 9 aa, Artificial Sequence
  Description of Artificial Sequence: Synthetic peptide
QQRISWPLT

SEQ ID NO: 148 - protein, 9 aa, Artificial Sequence
  Description of Artificial Sequence: Synthetic peptide
HQRINWPLT

SEQ ID NO: 149 - protein, 9 aa, Artificial Sequence
  Description of Artificial Sequence: Synthetic peptide
QHRINWPLT

SEQ ID NO: 150 - protein, 9 aa, Artificial Sequence
  Description of Artificial Sequence: Synthetic peptide
QQRIHWPLT

SEQ ID NO: 151 - protein, 8 aa, Artificial Sequence
  Description of Artificial Sequence: Synthetic peptide
QQYHNLPT

SEQ ID NO: 152 - protein, 6 aa, Artificial Sequence
  Description of Artificial Sequence: Synthetic peptide
QSIGSS

SEQ ID NO: 153 - protein, 6 aa, Artificial Sequence
  Description of Artificial Sequence: Synthetic peptide
QGISSW

SEQ ID NO: 154 - protein, 6 aa, Artificial Sequence
  Description of Artificial Sequence: Synthetic peptide
QSVSYY

SEQ ID NO: 155 - protein, 6 aa, Artificial Sequence
  Description of Artificial Sequence: Synthetic peptide
QDISNY

SEQ ID NO: 156 - protein, 7 aa, Artificial Sequence
  Description of Artificial Sequence: Synthetic peptide
QSVSSNY

SEQ ID NO: 157 - protein, 6 aa, Artificial Sequence
  Description of Artificial Sequence: Synthetic peptide
QDITNY

SEQ ID NO: 158 - protein, 6 aa, Artificial Sequence
  Description of Artificial Sequence: Synthetic peptide
QSIGTS

SEQ ID NO: 159 - protein, 6 aa, Artificial Sequence
  Description of Artificial Sequence: Synthetic peptide
QSVNYY

SEQ ID NO: 160 - protein, 6 aa, Artificial Sequence
  Description of Artificial Sequence: Synthetic peptide
QSVSHY

SEQ ID NO: 161 - protein, 6 aa, Artificial Sequence
  Description of Artificial Sequence: Synthetic peptide
QSVSYH

SEQ ID NO: 162 - protein, 6 aa, Artificial Sequence
  Description of Artificial Sequence: Synthetic peptide
QHITNY

SEQ ID NO: 163 - protein, 2 aa, Artificial Sequence
  Description of Artificial Sequence: Synthetic peptide
YA

SEQ ID NO: 164 - protein, 2 aa, Artificial Sequence
  Description of Artificial Sequence: Synthetic peptide
AA

SEQ ID NO: 165 - protein, 2 aa, Artificial Sequence
  Description of Artificial Sequence: Synthetic peptide
DA

SEQ ID NO: 166 - protein, 2 aa, Artificial Sequence
  Description of Artificial Sequence: Synthetic peptide
GA

SEQ ID NO: 167 - protein, 2 aa, Artificial Sequence
  Description of Artificial Sequence: Synthetic peptide
HA

SEQ ID NO: 168 - protein, 9 aa, Artificial Sequence
  Description of Artificial Sequence: Synthetic peptide
HQSSSLPQT

SEQ ID NO: 169 - protein, 9 aa, Artificial Sequence
  Description of Artificial Sequence: Synthetic peptide
QQYNSYPYT

SEQ ID NO: 170 - protein, 9 aa, Artificial Sequence
  Description of Artificial Sequence: Synthetic peptide
QQRINWPLT

SEQ ID NO: 171 - protein, 9 aa, Artificial Sequence
  Description of Artificial Sequence: Synthetic peptide
QQHDHLPWT

SEQ ID NO: 172 - protein, 8 aa, Artificial Sequence
  Description of Artificial Sequence: Synthetic peptide
QQYGYSYT

SEQ ID NO: 173 - protein, 8 aa, Artificial Sequence
  Description of Artificial Sequence: Synthetic peptide
QQYDNLPT

SEQ ID NO: 174 - protein, 9 aa, Artificial Sequence
  Description of Artificial Sequence: Synthetic peptide
HQRSSLPQT

SEQ ID NO: 175 - protein, 9 aa, Artificial Sequence
  Description of Artificial Sequence: Synthetic peptide
HQSSCLPQT

SEQ ID NO: 176 - protein, 9 aa, Artificial Sequence
  Description of Artificial Sequence: Synthetic peptide
HQSSSFPQT

SEQ ID NO: 177 - protein, 9 aa, Artificial Sequence
  Description of Artificial Sequence: Synthetic peptide
HQSSSLPHT

SEQ ID NO: 178 - protein, 9 aa, Artificial Sequence
  Description of Artificial Sequence: Synthetic peptide
HQSSSLPLT

SEQ ID NO: 179 - protein, 9 aa, Artificial Sequence
  Description of Artificial Sequence: Synthetic peptide
HQSSSLPPT

SEQ ID NO: 180 - protein, 9 aa, Artificial Sequence
  Description of Artificial Sequence: Synthetic peptide
HQSSSLPQK

SEQ ID NO: 181 - protein, 9 aa, Artificial Sequence
  Description of Artificial Sequence: Synthetic peptide
HQSSSLPQP

SEQ ID NO: 182 - protein, 9 aa, Artificial Sequence
  Description of Artificial Sequence: Synthetic peptide
QQRINWPLP

SEQ ID NO: 183 - protein, 9 aa, Artificial Sequence
  Description of Artificial Sequence: Synthetic peptide
QQRISWPLT

SEQ ID NO: 184 - protein, 9 aa, Artificial Sequence
  Description of Artificial Sequence: Synthetic peptide
HQRINWPLT

SEQ ID NO: 185 - protein, 9 aa, Artificial Sequence
  Description of Artificial Sequence: Synthetic peptide
QHRINWPLT

SEQ ID NO: 186 - protein, 9 aa, Artificial Sequence
  Description of Artificial Sequence: Synthetic peptide
QQRIHWPLT

SEQ ID NO: 187 - protein, 8 aa, Artificial Sequence
  Description of Artificial Sequence: Synthetic peptide
QQYHNLPT

SEQ ID NO: 188 - protein, 8 aa, Artificial Sequence
  Description of Artificial Sequence: Synthetic peptide
QSIGSSLH

SEQ ID NO: 189 - protein, 8 aa, Artificial Sequence
  Description of Artificial Sequence: Synthetic peptide
QGISSWLA

SEQ ID NO: 190 - protein, 8 aa, Artificial Sequence
  Description of Artificial Sequence: Synthetic peptide
QSVSYYLA

SEQ ID NO: 191 - protein, 8 aa, Artificial Sequence
  Description of Artificial Sequence: Synthetic peptide
QDISNYLN

SEQ ID NO: 192 - protein, 9 aa, Artificial Sequence
  Description of Artificial Sequence: Synthetic peptide
QSVSSNYLA

SEQ ID NO: 193 - protein, 8 aa, Artificial Sequence
  Description of Artificial Sequence: Synthetic peptide
QDITNYLT

SEQ ID NO: 194 - protein, 8 aa, Artificial Sequence
  Description of Artificial Sequence: Synthetic peptide
QSIGTSLH

SEQ ID NO: 195 - protein, 8 aa, Artificial Sequence
  Description of Artificial Sequence: Synthetic peptide
QSIGSSLQ

SEQ ID NO: 196 - protein, 8 aa, Artificial Sequence
  Description of Artificial Sequence: Synthetic peptide
QHITNYLT

SEQ ID NO: 197 - protein, 11 aa, Artificial Sequence
  Description of Artificial Sequence: Synthetic peptide
LLIKYASQSIS

SEQ ID NO: 198 - protein, 11 aa, Artificial Sequence
  Description of Artificial Sequence: Synthetic peptide
SLIYAASSLQS

SEQ ID NO: 199 - protein, 11 aa, Artificial Sequence
  Description of Artificial Sequence: Synthetic peptide
LLIYDAFNRAT

SEQ ID NO: 200 - protein, 11 aa, Artificial Sequence
  Description of Artificial Sequence: Synthetic peptide
LLIYDASNLET

SEQ ID NO: 201 - protein, 11 aa, Artificial Sequence
  Description of Artificial Sequence: Synthetic peptide
LLIYGASSRAT

SEQ ID NO: 202 - protein, 11 aa, Artificial Sequence
  Description of Artificial Sequence: Synthetic peptide
LLIKYASQSFS

SEQ ID NO: 203 - protein, 11 aa, Artificial Sequence
  Description of Artificial Sequence: Synthetic peptide
LLIYHAFNRAT

SEQ ID NO: 204 - protein, 11 aa, Artificial Sequence
  Description of Artificial Sequence: Synthetic peptide
LLIYDAFHRAT

SEQ ID NO: 205 - protein, 11 aa, Artificial Sequence
  Description of Artificial Sequence: Synthetic peptide
LLIYHASNLET

SEQ ID NO: 206 - protein, 11 aa, Artificial Sequence
  Description of Artificial Sequence: Synthetic peptide
LLIYDASNLHT

SEQ ID NO: 207 - protein, 8 aa, Artificial Sequence
  Description of Artificial Sequence: Synthetic peptide
HQSSSLPQ

SEQ ID NO: 208 - protein, 8 aa, Artificial Sequence
  Description of Artificial Sequence: Synthetic peptide
QQYNSYPY

SEQ ID NO: 209 - protein, 8 aa, Artificial Sequence
  Description of Artificial Sequence: Synthetic peptide
QQRINWPL

SEQ ID NO: 210 - protein, 8 aa, Artificial Sequence
  Description of Artificial Sequence: Synthetic peptide
QQHDHLPW

SEQ ID NO: 211 - protein, 7 aa, Artificial Sequence
  Description of Artificial Sequence: Synthetic peptide
QQYGYSY

SEQ ID NO: 212 - protein, 7 aa, Artificial Sequence
  Description of Artificial Sequence: Synthetic peptide
QQYDNLP

SEQ ID NO: 213 - protein, 8 aa, Artificial Sequence
  Description of Artificial Sequence: Synthetic peptide
HQRSSLPQ

SEQ ID NO: 214 - protein, 8 aa, Artificial Sequence
  Description of Artificial Sequence: Synthetic peptide
HQSSCLPQ

SEQ ID NO: 215 - protein, 8 aa, Artificial Sequence
  Description of Artificial Sequence: Synthetic peptide
HQSSSFPQ

SEQ ID NO: 216 - protein, 8 aa, Artificial Sequence
  Description of Artificial Sequence: Synthetic peptide
HQSSSLPH

SEQ ID NO: 217 - protein, 8 aa, Artificial Sequence
  Description of Artificial Sequence: Synthetic peptide
HQSSSLPL

SEQ ID NO: 218 - protein, 8 aa, Artificial Sequence
  Description of Artificial Sequence: Synthetic peptide
HQSSSLPP

SEQ ID NO: 219 - protein, 9 aa, Artificial Sequence
  Description of Artificial Sequence: Synthetic peptide
HQSSSLPQK

SEQ ID NO: 220 - protein, 9 aa, Artificial Sequence
  Description of Artificial Sequence: Synthetic peptide
HQSSSLPQP

SEQ ID NO: 221 - protein, 9 aa, Artificial Sequence
  Description of Artificial Sequence: Synthetic peptide
QQRINWPLP

SEQ ID NO: 222 - protein, 8 aa, Artificial Sequence
  Description of Artificial Sequence: Synthetic peptide
QQRISWPL

SEQ ID NO: 223 - protein, 8 aa, Artificial Sequence
  Description of Artificial Sequence: Synthetic peptide
HQRINWPL

SEQ ID NO: 224 - protein, 8 aa, Artificial Sequence
  Description of Artificial Sequence: Synthetic peptide
QHRINWPL

SEQ ID NO: 225 - protein, 8 aa, Artificial Sequence
  Description of Artificial Sequence: Synthetic peptide
QQRIHWPL

SEQ ID NO: 226 - protein, 7 aa, Artificial Sequence
  Description of Artificial Sequence: Synthetic peptide
QQYHNLP

SEQ ID NO: 227 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGHIYYSGSTNYNPSLKSRVTISVDTSKSQFSLKLSSVTAADTAVYYCARDIPAFAFDIWGQGTMVIVSS

SEQ ID NO: 228 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIHYSGSTNYNPSLKSRVTISVDTSKSQFSLKLSSVTAADTAVYYCARDIPAFAFDIWGQGTMVIVSS

SEQ ID NO: 229 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYHSGSTNYNPSLKSRVTISVDTSKSQFSLKLSSVTAADTAVYYCARDIPAFAFDIWGQGTMVIVSS

SEQ ID NO: 230 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTHYNPSLKSRVTISVDTSKSQFSLKLSSVTAADTAVYYCARDIPAFAFDIWGQGTMVIVSS

SEQ ID NO: 231 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNHNPSLKSRVTISVDTSKSQFSLKLSSVTAADTAVYYCARDIPAFAFDIWGQGTMVIVSS

SEQ ID NO: 232 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYHPSLKSRVTISVDTSKSQFSLKLSSVTAADTAVYYCARDIPAFAFDIWGQGTMVIVSS

SEQ ID NO: 233 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARHIPAFAFDIWGQGTMVIVSS

SEQ ID NO: 234 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFHIWGQGTMVIVSS

SEQ ID NO: 235 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYDRPYFYYGMDVWGQGTTVTVSSA

SEQ ID NO: 236 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRDEDTAVYYCARERDYERPYFYYGMDVWGQGTTVTVSSA

SEQ ID NO: 237 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDCERPYFYYGMDVWGQGTTVTVSSA

SEQ ID NO: 238 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSSA

SEQ ID NO: 239 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSS

SEQ ID NO: 240 - protein, 125 aa, Artificial Sequence
  Description of Artificial Sequence: Synthetic polypeptide
QVQLVESGGGVVQPGRSLRLSCAASGFTFSSYGMHWVRQAPGQGLEWVEDIWYDGSNKHYADSVKGRFTISRDNSKNTLYLQMNSLRAEDTAVYYCARESDYERPYFDYGMDVWGQGTTVTVSSA

SEQ ID NO: 241 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGIDVWGQGTTVTVSSA

SEQ ID NO: 242 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYESPYFYYGMDVWGQGTTVTVSSA

SEQ ID NO: 243 - protein, 118 aa, Artificial Sequence
  Description of Artificial Sequence: Synthetic polypeptide
QVQLQESGPGLVKPSETLSLTCTVSGGSVSSYYWSWIRQPPGKGLEWIGYIYYSGSTNYNPSLKSRVTISVDTSKSQFSLKLGSVTAADTAGYYCARDIPAFAFEIWGQGTMVIVSSA

SEQ ID NO: 244 - protein, 118 aa, Artificial Sequence
  Description of Artificial Sequence: Synthetic polypeptide
QVQLQESGPGLVKPSETLSLTCTVSGGSISSYYWSWIRKPPGKGLEWIGYIYYSGSTNYNPSLKSRVTISVDTSKSQFSLKLSSVTAADTAVYYCARDIPAFALDIWGQGTMVTVSSA

SEQ ID NO: 245 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPASAFDIWGQGTMVIVSSA

SEQ ID NO: 246 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKSQFSLKLSSVTAADTAVYYCASDIPAFAFDIWGQGTMVIVSSA

SEQ ID NO: 247 - protein, 5 aa, Artificial Sequence
  Description of Artificial Sequence: Synthetic peptide
SYGMH

SEQ ID NO: 248 - protein, 7 aa, Artificial Sequence
  Description of Artificial Sequence: Synthetic peptide
SSGYYWG

SEQ ID NO: 249 - protein, 5 aa, Artificial Sequence
  Description of Artificial Sequence: Synthetic peptide
SYYWS

SEQ ID NO: 250 - protein, 5 aa, Artificial Sequence
  Description of Artificial Sequence: Synthetic peptide
SYAMN

SEQ ID NO: 251 - protein, 5 aa, Artificial Sequence
  Description of Artificial Sequence: Synthetic peptide
SYAMS

SEQ ID NO: 252 - protein, 5 aa, Artificial Sequence
  Description of Artificial Sequence: Synthetic peptide
SHYWS

SEQ ID NO: 253 - protein, 5 aa, Artificial Sequence
  Description of Artificial Sequence: Synthetic peptide
SYHWS

SEQ ID NO: 254 - protein, 17 aa, Artificial Sequence
  Description of Artificial Sequence: Synthetic peptide
DIWYDGSNKHYADSVKG

SEQ ID NO: 255 - protein, 16 aa, Artificial Sequence
  Description of Artificial Sequence: Synthetic peptide
SLYSSGYTYYNPSLKS

SEQ ID NO: 256 - protein, 16 aa, Artificial Sequence
  Description of Artificial Sequence: Synthetic peptide
YIYYSGSTNYNPSLKS

SEQ ID NO: 257 - protein, 17 aa, Artificial Sequence
  Description of Artificial Sequence: Synthetic peptide
AISGSGGITYYADSVKG

SEQ ID NO: 258 - protein, 17 aa, Artificial Sequence
  Description of Artificial Sequence: Synthetic peptide
VISGSGGITYYSDSVKG

SEQ ID NO: 259 - protein, 16 aa, Artificial Sequence
  Description of Artificial Sequence: Synthetic peptide
SIFYSGNTHYNPSLKS

SEQ ID NO: 260 - protein, 16 aa, Artificial Sequence
  Description of Artificial Sequence: Synthetic peptide
HIYYSGSTNYNPSLKS

SEQ ID NO: 261 - protein, 16 aa, Artificial Sequence
  Description of Artificial Sequence: Synthetic peptide
YIHYSGSTNYNPSLKS

SEQ ID NO: 262 - protein, 16 aa, Artificial Sequence
  Description of Artificial Sequence: Synthetic peptide
YIYHSGSTNYNPSLKS

SEQ ID NO: 263 - protein, 16 aa, Artificial Sequence
  Description of Artificial Sequence: Synthetic peptide
YIYYSGSTHYNPSLKS

SEQ ID NO: 264 - protein, 16 aa, Artificial Sequence
  Description of Artificial Sequence: Synthetic peptide
YIYYSGSTNHNPSLKS

SEQ ID NO: 265 - protein, 16 aa, Artificial Sequence
  Description of Artificial Sequence: Synthetic peptide
YIYYSGSTNYHPSLKS

SEQ ID NO: 266 - protein, 15 aa, Artificial Sequence
  Description of Artificial Sequence: Synthetic peptide
ESDYERPYFYYGMDV

SEQ ID NO: 267 - protein, 9 aa, Artificial Sequence
  Description of Artificial Sequence: Synthetic peptide
HPVAMNFDD

SEQ ID NO: 268 - protein, 9 aa, Artificial Sequence
  Description of Artificial Sequence: Synthetic peptide
DIPAFAFDI

SEQ ID NO: 269 - protein, 9 aa, Artificial Sequence
  Description of Artificial Sequence: Synthetic peptide
DWELGRFDY

SEQ ID NO: 270 - protein, 10 aa, Artificial Sequence
  Description of Artificial Sequence: Synthetic peptide
DWEFFWYFDL

SEQ ID NO: 271 - protein, 10 aa, Artificial Sequence
  Description of Artificial Sequence: Synthetic peptide
RDILTGPFDY

SEQ ID NO: 272 - protein, 9 aa, Artificial Sequence
  Description of Artificial Sequence: Synthetic peptide
HIPAFAFDI

SEQ ID NO: 273 - protein, 9 aa, Artificial Sequence
  Description of Artificial Sequence: Synthetic peptide
DIPAFAFHI

SEQ ID NO: 274 - protein, 15 aa, Artificial Sequence
  Description of Artificial Sequence: Synthetic peptide
ESDYDRPYFYYGMDV

SEQ ID NO: 275 - protein, 15 aa, Artificial Sequence
  Description of Artificial Sequence: Synthetic peptide
ERDYERPYFYYGMDV

SEQ ID NO: 276 - protein, 15 aa, Artificial Sequence
  Description of Artificial Sequence: Synthetic peptide
ESDCERPYFYYGMDV

SEQ ID NO: 277 - protein, 15 aa, Artificial Sequence
  Description of Artificial Sequence: Synthetic peptide
ESDDERPYFYYGMDV

SEQ ID NO: 278 - protein, 15 aa, Artificial Sequence
  Description of Artificial Sequence: Synthetic peptide
ESDYERPYFDYGMDV

SEQ ID NO: 279 - protein, 15 aa, Artificial Sequence
  Description of Artificial Sequence: Synthetic peptide
ESDYERPYFYYGIDV

SEQ ID NO: 280 - protein, 15 aa, Artificial Sequence
  Description of Artificial Sequence: Synthetic peptide
ESDYESPYFYYGMDV

SEQ ID NO: 281 - protein, 9 aa, Artificial Sequence
  Description of Artificial Sequence: Synthetic peptide
DIPAFAFEI

SEQ ID NO: 282 - protein, 9 aa, Artificial Sequence
  Description of Artificial Sequence: Synthetic peptide
DIPAFALDI

SEQ ID NO: 283 - protein, 9 aa, Artificial Sequence
  Description of Artificial Sequence: Synthetic peptide
DIPASAFDI

SEQ ID NO: 284 - protein, 10 aa, Artificial Sequence
  Description of Artificial Sequence: Synthetic peptide
GFTFSSYGMH

SEQ ID NO: 285 - protein, 12 aa, Artificial Sequence
  Description of Artificial Sequence: Synthetic peptide
GGSISSSGYYWG

SEQ ID NO: 286 - protein, 10 aa, Artificial Sequence
  Description of Artificial Sequence: Synthetic peptide
GGSISSYYWS

SEQ ID NO: 287 - protein, 10 aa, Artificial Sequence
  Description of Artificial Sequence: Synthetic peptide
GFTFSSYAMN

SEQ ID NO: 288 - protein, 10 aa, Artificial Sequence
  Description of Artificial Sequence: Synthetic peptide
GFTFSSYAMS

SEQ ID NO: 289 - protein, 10 aa, Artificial Sequence
  Description of Artificial Sequence: Synthetic peptide
GGSISSHYWS

SEQ ID NO: 290 - protein, 10 aa, Artificial Sequence
  Description of Artificial Sequence: Synthetic peptide
GGSISSYHWS

SEQ ID NO: 291 - protein, 10 aa, Artificial Sequence
  Description of Artificial Sequence: Synthetic peptide
GGSVSSYYWS

SEQ ID NO: 292 - protein, 7 aa, Artificial Sequence
  Description of Artificial Sequence: Synthetic peptide
IWYDGSN

SEQ ID NO: 293 - protein, 6 aa, Artificial Sequence
  Description of Artificial Sequence: Synthetic peptide
LYSSGY

SEQ ID NO: 294 - protein, 6 aa, Artificial Sequence
  Description of Artificial Sequence: Synthetic peptide
IYYSGS

SEQ ID NO: 295 - protein, 7 aa, Artificial Sequence
  Description of Artificial Sequence: Synthetic peptide
ISGSGGI

SEQ ID NO: 296 - protein, 6 aa, Artificial Sequence
  Description of Artificial Sequence: Synthetic peptide
IFYSGN

SEQ ID NO: 297 - protein, 6 aa, Artificial Sequence
  Description of Artificial Sequence: Synthetic peptide
IHYSGS

SEQ ID NO: 298 - protein, 6 aa, Artificial Sequence
  Description of Artificial Sequence: Synthetic peptide
IYHSGS

SEQ ID NO: 299 - protein, 17 aa, Artificial Sequence
  Description of Artificial Sequence: Synthetic peptide
ARESDYERPYFYYGMDV

SEQ ID NO: 300 - protein, 11 aa, Artificial Sequence
  Description of Artificial Sequence: Synthetic peptide
ARHPVAMNFDD

SEQ ID NO: 301 - protein, 11 aa, Artificial Sequence
  Description of Artificial Sequence: Synthetic peptide
ARDIPAFAFDI

SEQ ID NO: 302 - protein, 11 aa, Artificial Sequence
  Description of Artificial Sequence: Synthetic peptide
ARDWELGRFDY

SEQ ID NO: 303 - protein, 12 aa, Artificial Sequence
  Description of Artificial Sequence: Synthetic peptide
AKDWEFFWYFDL

SEQ ID NO: 304 - protein, 12 aa, Artificial Sequence
  Description of Artificial Sequence: Synthetic peptide
ARRDILTGPFDY

SEQ ID NO: 305 - protein, 11 aa, Artificial Sequence
  Description of Artificial Sequence: Synthetic peptide
ARHIPAFAFDI

SEQ ID NO: 306 - protein, 11 aa, Artificial Sequence
  Description of Artificial Sequence: Synthetic peptide
ARDIPAFAFHI

SEQ ID NO: 307 - protein, 17 aa, Artificial Sequence
  Description of Artificial Sequence: Synthetic peptide
ARESDYDRPYFYYGMDV

SEQ ID NO: 308 - protein, 17 aa, Artificial Sequence
  Description of Artificial Sequence: Synthetic peptide
ARERDYERPYFYYGMDV

SEQ ID NO: 309 - protein, 17 aa, Artificial Sequence
  Description of Artificial Sequence: Synthetic peptide
ARESDCERPYFYYGMDV

SEQ ID NO: 310 - protein, 17 aa, Artificial Sequence
  Description of Artificial Sequence: Synthetic peptide
ARESDDERPYFYYGMDV

SEQ ID NO: 311 - protein, 17 aa, Artificial Sequence
  Description of Artificial Sequence: Synthetic peptide
ARESDYERPYFDYGMDV

SEQ ID NO: 312 - protein, 17 aa, Artificial Sequence
  Description of Artificial Sequence: Synthetic peptide
ARESDYERPYFYYGIDV

SEQ ID NO: 313 - protein, 17 aa, Artificial Sequence
  Description of Artificial Sequence: Synthetic peptide
ARESDYESPYFYYGMDV

SEQ ID NO: 314 - protein, 11 aa, Artificial Sequence
  Description of Artificial Sequence: Synthetic peptide
ARDIPAFAFEI

SEQ ID NO: 315 - protein, 11 aa, Artificial Sequence
  Description of Artificial Sequence: Synthetic peptide
ARDIPAFALDI

SEQ ID NO: 316 - protein, 11 aa, Artificial Sequence
  Description of Artificial Sequence: Synthetic peptide
ARDIPASAFDI

SEQ ID NO: 317 - protein, 11 aa, Artificial Sequence
  Description of Artificial Sequence: Synthetic peptide
ASDIPAFAFDI

SEQ ID NO: 318 - protein, 9 aa, Artificial Sequence
  Description of Artificial Sequence: Synthetic peptide
FTFSSYGMH

SEQ ID NO: 319 - protein, 11 aa, Artificial Sequence
  Description of Artificial Sequence: Synthetic peptide
GSISSSGYYWG

SEQ ID NO: 320 - protein, 9 aa, Artificial Sequence
  Description of Artificial Sequence: Synthetic peptide
GSISSYYWS

SEQ ID NO: 321 - protein, 9 aa, Artificial Sequence
  Description of Artificial Sequence: Synthetic peptide
FTFSSYAMN

SEQ ID NO: 322 - protein, 9 aa, Artificial Sequence
  Description of Artificial Sequence: Synthetic peptide
FTFSSYAMS

SEQ ID NO: 323 - protein, 9 aa, Artificial Sequence
  Description of Artificial Sequence: Synthetic peptide
GSISSHYWS

SEQ ID NO: 324 - protein, 9 aa, Artificial Sequence
  Description of Artificial Sequence: Synthetic peptide
GSISSYHWS

SEQ ID NO: 325 - protein, 9 aa, Artificial Sequence
  Description of Artificial Sequence: Synthetic peptide
GSVSSYYWS

SEQ ID NO: 326 - protein, 14 aa, Artificial Sequence
  Description of Artificial Sequence: Synthetic peptide
WVADIWYDGSNKHY

SEQ ID NO: 327 - protein, 13 aa, Artificial Sequence
  Description of Artificial Sequence: Synthetic peptide
WIGSLYSSGYTYY

SEQ ID NO: 328 - protein, 13 aa, Artificial Sequence
  Description of Artificial Sequence: Synthetic peptide
WIGYIYYSGSTNY

SEQ ID NO: 329 - protein, 15 aa, Artificial Sequence
  Description of Artificial Sequence: Synthetic peptide
WVSAISGSGGITYYA

SEQ ID NO: 330 - protein, 15 aa, Artificial Sequence
  Description of Artificial Sequence: Synthetic peptide
WVSVISGSGGITYYS

SEQ ID NO: 331 - protein, 13 aa, Artificial Sequence
  Description of Artificial Sequence: Synthetic peptide
WIGSIFYSGNTHY

SEQ ID NO: 332 - protein, 14 aa, Artificial Sequence
  Description of Artificial Sequence: Synthetic peptide
WVSAISGSGGITYY

SEQ ID NO: 333 - protein, 15 aa, Artificial Sequence
  Description of Artificial Sequence: Synthetic peptide
WVSVISGSGGITYYS

SEQ ID NO: 334 - protein, 13 aa, Artificial Sequence
  Description of Artificial Sequence: Synthetic peptide
WIGHIYYSGSTNY

SEQ ID NO: 335 - protein, 13 aa, Artificial Sequence
  Description of Artificial Sequence: Synthetic peptide
WIGYIHYSGSTNY

SEQ ID NO: 336 - protein, 13 aa, Artificial Sequence
  Description of Artificial Sequence: Synthetic peptide
WIGYIYHSGSTNY

SEQ ID NO: 337 - protein, 13 aa, Artificial Sequence
  Description of Artificial Sequence: Synthetic peptide
WIGYIYYSGSTHY

SEQ ID NO: 338 - protein, 13 aa, Artificial Sequence
  Description of Artificial Sequence: Synthetic peptide
WIGYIYYSGSTNH

SEQ ID NO: 339 - protein, 14 aa, Artificial Sequence
  Description of Artificial Sequence: Synthetic peptide
WVEDIWYDGSNKHY

SEQ ID NO: 340 - protein, 16 aa, Artificial Sequence
  Description of Artificial Sequence: Synthetic peptide
RESDYERPYFYYGMDV

SEQ ID NO: 341 - protein, 10 aa, Artificial Sequence
  Description of Artificial Sequence: Synthetic peptide
RHPVAMNFDD

SEQ ID NO: 342 - protein, 10 aa, Artificial Sequence
  Description of Artificial Sequence: Synthetic peptide
RDIPAFAFDI

SEQ ID NO: 343 - protein, 11 aa, Artificial Sequence
  Description of Artificial Sequence: Synthetic peptide
ARDWELGRFDY

SEQ ID NO: 344 - protein, 12 aa, Artificial Sequence
  Description of Artificial Sequence: Synthetic peptide
AKDWEFFWYFDL

SEQ ID NO: 345 - protein, 11 aa, Artificial Sequence
  Description of Artificial Sequence: Synthetic peptide
RRDILTGPFDY

SEQ ID NO: 346 - protein, 10 aa, Artificial Sequence
  Description of Artificial Sequence: Synthetic peptide
RDWELGRFDY

SEQ ID NO: 347 - protein, 10 aa, Artificial Sequence
  Description of Artificial Sequence: Synthetic peptide
RHIPAFAFDI

SEQ ID NO: 348 - protein, 10 aa, Artificial Sequence
  Description of Artificial Sequence: Synthetic peptide
RDIPAFAFHI

SEQ ID NO: 349 - protein, 16 aa, Artificial Sequence
  Description of Artificial Sequence: Synthetic peptide
RESDYDRPYFYYGMDV

SEQ ID NO: 350 - protein, 16 aa, Artificial Sequence
  Description of Artificial Sequence: Synthetic peptide
RERDYERPYFYYGMDV

SEQ ID NO: 351 - protein, 16 aa, Artificial Sequence
  Description of Artificial Sequence: Synthetic peptide
RESDCERPYFYYGMDV

SEQ ID NO: 352 - protein, 16 aa, Artificial Sequence
  Description of Artificial Sequence: Synthetic peptide
RESDDERPYFYYGMDV

SEQ ID NO: 353 - protein, 16 aa, Artificial Sequence
  Description of Artificial Sequence: Synthetic peptide
RESDYERPYFDYGMDV

SEQ ID NO: 354 - protein, 16 aa, Artificial Sequence
  Description of Artificial Sequence: Synthetic peptide
RESDYERPYFYYGIDV

SEQ ID NO: 355 - protein, 16 aa, Artificial Sequence
  Description of Artificial Sequence: Synthetic peptide
RESDYESPYFYYGMDV

SEQ ID NO: 356 - protein, 10 aa, Artificial Sequence
  Description of Artificial Sequence: Synthetic peptide
RDIPAFAFEI

SEQ ID NO: 357 - protein, 10 aa, Artificial Sequence
  Description of Artificial Sequence: Synthetic peptide
RDIPAFALDI

SEQ ID NO: 358 - protein, 10 aa, Artificial Sequence
  Description of Artificial Sequence: Synthetic peptide
RDIPASAFDI

SEQ ID NO: 359 - protein, 10 aa, Artificial Sequence
  Description of Artificial Sequence: Synthetic peptide
SDIPAFAFDI

SEQ ID NO: 360 - protein, 19 aa, Artificial Sequence
  Description of Artificial Sequence: Synthetic peptide
MGWSCIILFLVATATGVHS

SEQ ID NO: 361 - protein, 107 aa, Homo sapiens [sequence omitted]

SEQ ID NO: 362 - protein, 107 aa, Mus musculus
RADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 363 - protein, 330 aa, Homo sapiens [sequence omitted]

SEQ ID NO: 364 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 365 - protein, 330 aa, Mus musculus
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 366 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 367 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 368 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 370 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 371 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 372 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 373 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLGK

SEQ ID NO: 374 - protein, 330 aa, Artificial Sequence
  Description of Artificial Sequence: Synthetic polypeptide
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 375 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 376 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 377 - protein, 311 aa, Homo sapiens
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 378 - protein, 194 aa, Homo sapiens
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAA

SEQ ID NO: 379 - protein, 308 aa, Mus musculus
MGVPAVPEASSPRWGTLLLAIFLAASRGLVAAFKVTTPYSLYVCPEGQNATLTCRILGPVSKGHDVTIYKTWYLSSRGEVQMCKEHRPIRNFTLQHLQHHGSHLKANASHDQPQKHGLELASDHHGNFSITLRNVTPRDSGLYCCLVIELKNHHPEQRFYGSMELQVQAGKGSGSTCMASNEQDSDSITAAALATGACIVGILCLPLILLLVYKQRQVASHRRAQELVRMDSNTQGIENPGFETTPPFQGMPEAKTRPPLSYVAQRQPSESGRYLLSDPSTPLSPPGPGDVFFPSLDPVPDSPNSEAI

SEQ ID NO: 380 - protein, 311 aa, Macaca fascicularis
MGVPTAPEAGCWRWGSLLFALFLAASLGPVAAFKVATLYSLYVCPEGQNVTLTCRVFGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSSCVAYPSSSQESENITAAALATGACIVGILCLPLILLLVYKQRQAASNRRAQELVRMDSNTQGIENPGFEASSPAQGILEAKVRHPLSYVAQRQPSESGRHLLSEPGTPLSPPGPGDVFFPSLDPVPDSPNFEVI

SEQ ID NO: 381 - protein, 431 aa, Homo sapiens
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 382 - protein, 431 aa, Artificial Sequence
  Description of Artificial Sequence: Synthetic polypeptide
MGVPTALEAGSWRWGSLLFALFLAASLGPVAAFKVATPYSLYVCPEGQNVTLTCRLLGPVDKGHDVTFYKTWYRSSRGEVQTCSEARPIRNLTAADLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - protein, 120 aa, Artificial Sequence
  Description of Artificial Sequence: Synthetic polypeptide
QLQLQESGPGLVKPSETLSLTCTVSGGSISSSGYYWGWIRQPPGKGLEWIGSLYSSGYTYYNPSLKSRVTISVDTSKNQFSLKLNSVTTADTAVYYCARHPVAMNFDDWGQGTLVTVSSA

SEQ ID NO: 384 - protein, 120 aa, Artificial Sequence
  Description of Artificial Sequence: Synthetic polypeptide
QLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSA

SEQ ID NO: 385 - protein, 120 aa, Artificial Sequence
  Description of Artificial Sequence: Synthetic polypeptide
QLQLQESGPGLVKPSETLSLTCTVSGGSISSSGYYWGWIRQPPGKGLEWIGSLYSSGYTYYNPSLKSRVTISVDTSKNQSSLKLNSVTTADTAVYYCARHPVAMNFDDWGQGTLVTVSSA

SEQ ID NO: 386 - protein, 120 aa, Artificial Sequence; identical to SEQ ID NO: 384
  Description of Artificial Sequence: Synthetic polypeptide

SEQ ID NO: 387 - protein, 233 aa, Artificial Sequence
  Description of Artificial Sequence: Synthetic polypeptide
MGWSCIILFLVATATGVHSEIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 388 - protein, 233 aa, Artificial Sequence
  Description of Artificial Sequence: Synthetic polypeptide
MGWSCIILFLVATATGVHSEIVLTQSPDFQSVTPKEKVTITCRASQSIGSSLHWYQQKPDQSPKLLIKYASQSISGVPSRFSGSGSGTDFTLTINSLEAEDAAAYYCHQSSSLPQTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 389 - protein, 233 aa, Artificial Sequence
  Description of Artificial Sequence: Synthetic polypeptide
MGWSCIILFLVATATGVHSDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 233 aa, Artificial Sequence
  Description of Artificial Sequence: Synthetic polypeptide
MGWSCIILFLVATATGVHSDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 391 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYDAFNRATGIPARFSGSGSGTDFTLTISSLEPEDFAVYYCQQRINWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 392 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYDAFNRATGIPARFSGSGSGTDFTLTISSLEPEDFAVYYCQQRINWPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 393 - protein, 233 aa, Artificial Sequence
  Description of Artificial Sequence: Synthetic polypeptide
MGWSCIILFLVATATGVHSEIVLTQSPATLSLSPGERATLSCRASQSVSHYLAWYQQKPGQAPRLLIYDAFNRATGIPARFSGSGSGTDFTLTISSLEPEDFAVYYCQQRINWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 233 aa, Artificial Sequence
  Description of Artificial Sequence: Synthetic polypeptide
MGWSCIILFLVATATGVHSEIVLTQSPATLSLSPGERATLSCRASQSVSYHLAWYQQKPGQAPRLLIYDAFNRATGIPARFSGSGSGTDFTLTISSLEPEDFAVYYCQQRINWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 395 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYHAFNRATGIPARFSGSGSGTDFTLTISSLEPEDFAVYYCQQRINWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 396 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYDAFHRATGIPARFSGSGSGTDFTLTISSLEPEDFAVYYCQQRINWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 397 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYDAFNRATGIPARFSGSGSGTDFTLTISSLEPEDFAVYYCHQRINWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 398 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYDAFNRATGIPARFSGSGSGTDFTLTISSLEPEDFAVYYCQHRINWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 399 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYDAFNRATGIPARFSGSGSGTDFTLTISSLEPEDFAVYYCQQRIHWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 400 - protein, 233 aa, Artificial Sequence
  Description of Artificial Sequence: Synthetic polypeptide
MGWSCIILFLVATATGVHSDIQMTQSPSSLSASVGDRVTITCQASQDISNYLNWYQQKPGRAPELLIYDASNLETGVPSRFSGSGSGTDFTFTISSLQPEDFATYSCQQHDHLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 401 - protein, 233 aa, Artificial Sequence
  Description of Artificial Sequence: Synthetic polypeptide
MGWSCIILFLVATATGVHSEIVLTQSPATLSLSPGERATLSCGASQSVSSNYLAWYQQKPGLAPRLLIYGASSRATGVPDRFSGSGSGTDFTLTISRLEPEDFAVYYCQQYGYSYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 402 - protein, 232 aa, Artificial Sequence
  Description of Artificial Sequence: Synthetic polypeptide
MGWSCIILFLVATATGVHSDIQMTQSPSSLSASVGDRVTITCQASQDITNYLTWYQQKPGNAPKLLIYDASNLETGVPSRFSGSGSGTDFTFTINSLQPEDVATYFCQQYDNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 403 - protein, 232 aa, Artificial Sequence
  Description of Artificial Sequence: Synthetic polypeptide
MGWSCIILFLVATATGVHSDIQMTQSPSSLSASVGDRVTITCQASQHITNYLTWYQQKPGNAPKLLIYDASNLETGVPSRFSGSGSGTDFTFTINSLQPEDVATYFCQQYDNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - protein, 232 aa, Artificial Sequence
  Description of Artificial Sequence: Synthetic polypeptide
MGWSCIILFLVATATGVHSDIQMTQSPSSLSASVGDRVTITCQASQDITNYLTWYQQKPGNAPKLLIYHASNLETGVPSRFSGSGSGTDFTFTINSLQPEDVATYFCQQYDNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 405 - protein, 232 aa, Artificial Sequence
  Description of Artificial Sequence: Synthetic polypeptide
MGWSCIILFLVATATGVHSDIQMTQSPSSLSASVGDRVTITCQASQDITNYLTWYQQKPGNAPKLLIYDASNLETGVPSRFSGSGSGTDFTFTINSLQPEDVATYFCQQYHNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 232 aa, Artificial Sequence
  Description of Artificial Sequence: Synthetic polypeptide
MGWSCIILFLVATATGVHSDIQMTQSPSSLSASVGDRVTITCQASQDITNYLTWYQQKPGNAPKLLIYDASNLHTGVPSRFSGSGSGTDFTFTINSLQPEDVATYFCQQYDNLPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 407 - protein, 474 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - protein, 473 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 409 - protein, 474 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 410 - protein, 473 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - protein, 473 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 412 - protein, 470 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 413 - protein, 469 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQCSLKLNSVTTADTAVYYCARHPVAMNFDDWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 469 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQCSLKLNSVTTADTAVYYCARHPVAMNFDDWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 469 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQCSLKLNSVTTADTAVYYCARHPVAMNFDDWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 416 - protein, 469 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQFSLKLNSVTTADTAVYYCARHPVAMNFDDWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 469 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 418 - protein, 469 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQSSLKLNSVTTADTAVYYCARHPVAMNFDDWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 468 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - protein, 468 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 421 - protein, 468 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 422 - protein, 467 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 423 - protein, 468 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 424 - protein, 465 aa, Artificial Sequence
  Description of Artificial Sequence: Synthetic polypeptide
MGWSCIILFLVATATGVHSQLQLQESGPGLVKPSETLSLTCTVSGGSISSSGYYWGWIRQPPGKGLEWIGSLYSSGYTYYNPSLKSRVTISVDTSKNQASLKLNSVTTADTAVYYCARHPVAMNFDDWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 425 - protein, 467 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 467 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 427 - protein, 467 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 428 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 430 - protein, 466 aa, Artificial Sequence
  Description of Artificial Sequence: Synthetic polypeptide
MGWSCIILFLVATATGVHSQVQLQESGPGLVKPSETLSLTCTVSGGSISSHYWSWIRQPPGKGLEWIGYIYYSGSTNYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 466 aa, Artificial Sequence
  Description of Artificial Sequence: Synthetic polypeptide
MGWSCIILFLVATATGVHSQVQLQESGPGLVKPSETLSLTCTVSGGSISSYHWSWIRQPPGKGLEWIGYIYYSGSTNYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGHIYYSGSTNYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 433 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIHYSGSTNYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 434 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYHSGSTNYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTHYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 436 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNHNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 437 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYHPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 438 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARHIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 439 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFHIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 440 - protein, 467 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 441 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 442 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 443 - protein, 464 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 444 - protein, 463 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 445 - protein, 468 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 446 - protein, 468 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 447 - protein, 467 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 448 - protein, 468 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 449 - protein, 468 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 450 - protein, 467 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 451 - protein, 465 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 452 - protein, 464 aa, Artificial Sequence
  Description of Artificial Sequence: Synthetic polypeptide
MGWSCIILFLVATATGVHSEVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 453 - protein, 469 aa, Artificial Sequence
  Description of Artificial Sequence: Synthetic polypeptide
MGWSCIILFLVATATGVHSEVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 454 - protein, 469 aa, Artificial Sequence
  Description of Artificial Sequence: Synthetic polypeptide
MGWSCIILFLVATATGVHSEVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 455 - protein, 468 aa, Artificial Sequence
  Description of Artificial Sequence: Synthetic polypeptide
MGWSCIILFLVATATGVHSEVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 456 - protein, 469 aa, Artificial Sequence
  Description of Artificial Sequence: Synthetic polypeptide
MGWSCIILFLVATATGVHSEVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 457 - protein, 468 aa, Artificial Sequence
  Description of Artificial Sequence: Synthetic polypeptide
MGWSCIILFLVATATGVHSEVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 468 aa, Artificial Sequence
  Description of Artificial Sequence: Synthetic polypeptide
MGWSCIILFLVATATGVHSEVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 459 - protein, 465 aa, Artificial Sequence
  Description of Artificial Sequence: Synthetic polypeptide
MGWSCIILFLVATATGVHSEVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 460 - protein, 470 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 461 - protein, 470 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 470 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 463 - protein, 470 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 464 - protein, 470 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 465 - protein, 469 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 466 - protein, 469 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 467 - protein, 469 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 468 - protein, 467 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 469 - protein, 466 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 470 - protein, 467 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 471 - protein, 467 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 472 - protein, 467 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLGK

SEQ ID NO: 473 - protein, 466 aa, Artificial Sequence
  Description of Artificial Sequence: Synthetic polypeptide
MGWSCIILFLVATATGVHSQLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 474 - protein, 474 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 473 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 476 - protein, 473 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 477 - protein, 470 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDDERPYFYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 478 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagagccccgatttccagagcgtgacccctaaagaaaaagtgaccatcacctgtcgggccagccagagcatcggatctagcctgcattggtatcagcagaagcccgatcagagccccaagctgctgattaagtacgccagccagtccatcagcggcgtgccaagcagattttctggcagcggctctggcaccgacttcaccctgacaatcaacagcctggaagccgaggatgccgccgcttactactgtcaccagtctagcagcctgcctcagacctttggccagggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 479 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagagccccgatttccagagcgtgacccctaaagaaaaagtgaccatcacctgtcgggccagccagagcatcggatctagcctgcattggtatcagcagaagcccgatcagagccccaagctgctgattaagtacgccagccagtccatcagcggcgtgccaagcagattttctggcagcggctctggcaccgacttcaccctgacaatcaacagcctggaagccgaggatgccgccgcttactactgtcaccagtctagcagcctgcctcagacctttggccagggcaccaaggtggaaatcaagagagccgacgccgcccctaccgtgtccatcttcccacctagctctgaacagctgaccagcggcggagccagcgtggtgtgcttcctgaacaacttctaccccaaggacatcaacgtgaagtggaagatcgacggcagcgagagacagaacggcgtgctgaatagctggaccgaccaggacagcaaggatagcacctacagcatgagcagcaccctgacactgaccaaggacgagtacgagcggcacaacagctacacatgcgaggccacacacaagaccagcacatctcctatcgtgaagagcttcaacagaaacgagtgctgataagctt

SEQ ID NO: 480 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctgcagtctggcgtgccatctagattttccggcagcggctctggcaccgacttcaccctgaccatatctagcctgcagcctgaggacttcgccacctactactgccagcagtacaacagctacccctacacctttggccagggcaccaagctggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 481 - DNA, 726 bp, Artificial Sequence
  Description of Artificial Sequence: Synthetic polynucleotide
gaattcccgccgccaccatgggctggtcctgcatcatcctgttcctggtggccaccgccacaggcgtgcacagcgagatcgtgctgacacagtctccagccaccctgagcctgtcacctggcgagagggccaccctgtcttgtagagcttctcagagcgtgtcttattacctggcctggtaccagcagaagcccggccaggcccctagactgctgatctacgacgccttcaacagagccaccggcatccccgccagattcagcggcagcggaagcggcaccgacttcaccctgaccatcagcagcctggaacctgaggacttcgccgtgtactactgccagcaaagaatcaactggcctctgaccttcggcggcgggaccaaggtggaaatcaagagagccgacgccgcccctaccgtgtccatcttcccacctagctctgaacagctgaccagcggcggagccagcgtggtgtgcttcctgaacaacttctaccccaaggacatcaacgtgaagtggaagatcgacggcagcgagagacagaacggcgtgctgaatagctggaccgaccaggacagcaaggatagcacctacagcatgagcagcaccctgacactgaccaaggacgagtacgagcggcacaacagctacacatgcgaggccacacacaagaccagcacatctcctatcgtgaagagcttcaacagaaacgagtgctgataagctt

SEQ ID NO: 482 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcctactacctggcctggtatcagcagaagcctggacaggctccccggctgctgatctacgacgccttcaatagagccacaggcatccccgccagattttctggctctggcagcggcaccgatttcaccctgaccataagcagcctggaacctgaggacttcgccgtgtactactgccagcagagaatcaactggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 483 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcccattacctggcctggtatcagcagaagcctggacaggctccccggctgctgatctacgacgccttcaatagagccacaggcatccccgccagattttctggctctggcagcggcaccgatttcaccctgaccataagcagcctggaacctgaggacttcgccgtgtactactgccagcagagaatcaactggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 484 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcctaccatctggcctggtatcagcagaagcctggacaggctccccggctgctgatctacgacgccttcaatagagccacaggcatccccgccagattttctggctctggcagcggcaccgatttcaccctgaccataagcagcctggaacctgaggacttcgccgtgtactactgccagcagagaatcaactggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 485 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcctactacctggcctggtatcagcagaagcctggacaggctccccggctgctgatctaccatgccttcaatagagccacaggcatccccgccagattttctggctctggcagcggcaccgatttcaccctgaccataagcagcctggaacctgaggacttcgccgtgtactactgccagcagagaatcaactggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 486 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcctactacctggcctggtatcagcagaagcctggacaggctccccggctgctgatctacgacgccttccatagagccacaggcatccccgccagattttctggctctggcagcggcaccgatttcaccctgaccataagcagcctggaacctgaggacttcgccgtgtactactgccagcagagaatcaactggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 487 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcctactacctggcctggtatcagcagaagcctggacaggctccccggctgctgatctacgacgccttcaatagagccacaggcatccccgccagattttctggctctggcagcggcaccgatttcaccctgaccataagcagcctggaacctgaggacttcgccgtgtactactgccatcagagaatcaactggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 488 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcctactacctggcctggtatcagcagaagcctggacaggctccccggctgctgatctacgacgccttcaatagagccacaggcatccccgccagattttctggctctggcagcggcaccgatttcaccctgaccataagcagcctggaacctgaggacttcgccgtgtactactgccagcatagaatcaactggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 489 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgtagagccagccagagcgtgtcctactacctggcctggtatcagcagaagcctggacaggctccccggctgctgatctacgacgccttcaatagagccacaggcatccccgccagattttctggctctggcagcggcaccgatttcaccctgaccataagcagcctggaacctgaggacttcgccgtgtactactgccagcagagaatccattggcccctgacctttggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 490 - DNA, 726 bp, Artificial Sequence; identical to SEQ ID NO: 481
  Description of Artificial Sequence: Synthetic polynucleotide

SEQ ID NO: 491 - DNA, 726 bp, Artificial Sequence; identical to SEQ ID NO: 482
  Description of Artificial Sequence: Synthetic polynucleotide

SEQ ID NO: 492 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccaggacatcagcaactacctgaactggtatcagcagaagcccggcagagcccctgagctgctgatctacgatgccagcaatctggaaaccggcgtgcccagcagattttctggcagcggctctggcaccgacttcaccttcaccataagcagcctgcagcctgaggacttcgccacctactcttgccagcagcacgaccatctgccttggacatttggccagggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 493 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccaggacatcagcaactacctgaactggtatcagcagaagcccggcagagcccctgagctgctgatctacgatgccagcaatctggaaaccggcgtgcccagcagattttctggcagcggctctggcaccgacttcaccttcaccataagcagcctgcagcctgaggacttcgccacctactcttgccagcagcacgaccatctgccttggacatttggccagggcaccaaggtggaaatcaagagagccgacgccgcccctaccgtgtccatcttcccacctagctctgaacagctgaccagcggcggagccagcgtggtgtgcttcctgaacaacttctaccccaaggacatcaacgtgaagtggaagatcgacggcagcgagagacagaacggcgtgctgaatagctggaccgaccaggacagcaaggatagcacctacagcatgagcagcaccctgacactgaccaaggacgagtacgagcggcacaacagctacacatgcgaggccacacacaagaccagcacatctcctatcgtgaagagcttcaacagaaacgagtgctgataagctt

SEQ ID NO: 494 - DNA, 726 bp, Artificial Sequence; identical to SEQ ID NO: 492
  Description of Artificial Sequence: Synthetic polynucleotide

SEQ ID NO: 495 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgcggagcctctcagagcgtgtccagcaattacctggcctggtatcagcagaagcccggactggctcctcggctgttgatctatggcgcctcttctagagccaccggcgtgcccgatagattttctggctctggcagcggcaccgacttcaccctgacaatcagcagactggaacccgaggacttcgccgtgtactactgtcagcagtacggctacagctacaccttcggccagggcaccaagctggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 496 - DNA, 726 bp, Artificial Sequence
  Description of Artificial Sequence: Synthetic polynucleotide
gaattcccgccgccaccatgggctggtcatgtattattctgtttctggtcgcaactgctacaggggtccatagtgagatcgtgctgacacagtctcccgccacactgtcactgtctccaggcgaaagagccacactgagctgcggagcctctcagagcgtgtccagcaattacctggcctggtatcagcagaagcccggactggctcctcggctgttgatctatggcgcctcttctagagccaccggcgtgcccgatagattttctggctctggcagcggcaccgacttcaccctgacaatcagcagactggaacccgaggacttcgccgtgtactactgtcagcagtacggctacagctacaccttcggccagggcaccaagctggaaatcaagagagccgacgccgcccctaccgtgtccatcttcccacctagctctgaacagctgaccagcggcggagccagcgtggtgtgcttcctgaacaacttctaccccaaggacatcaacgtgaagtggaagatcgacggcagcgagagacagaacggcgtgctgaatagctggaccgaccaggacagcaaggatagcacctacagcatgagcagcaccctgacactgaccaaggacgagtacgagcggcacaacagctacacatgcgaggccacacacaagaccagcacatctcctatcgtgaagagcttcaacagaaacgagtgctgataagctt

SEQ ID NO: 497 - DNA, 723 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccaggacatcaccaactacctgacctggtatcagcagaagcccggcaacgcccctaagctgctgatctacgatgccagcaacctggaaaccggcgtgcccagcagattttctggcagcggctctggcaccgacttcaccttcaccatcaacagcctgcagcctgaggacgtggccacctacttttgccagcagtacgacaacctgcctaccttcggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 498 - DNA, 723 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccagcatatcaccaactacctgacctggtatcagcagaagcccggcaacgcccctaagctgctgatctacgatgccagcaacctggaaaccggcgtgcccagcagattttctggcagcggctctggcaccgacttcaccttcaccatcaacagcctgcagcctgaggacgtggccacctacttttgccagcagtacgacaacctgcctaccttcggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 499 - DNA, 723 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccaggacatcaccaactacctgacctggtatcagcagaagcccggcaacgcccctaagctgctgatctaccatgccagcaacctggaaaccggcgtgcccagcagattttctggcagcggctctggcaccgacttcaccttcaccatcaacagcctgcagcctgaggacgtggccacctacttttgccagcagtacgacaacctgcctaccttcggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 500 - DNA, 723 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccaggacatcaccaactacctgacctggtatcagcagaagcccggcaacgcccctaagctgctgatctacgatgccagcaacctggaaaccggcgtgcccagcagattttctggcagcggctctggcaccgacttcaccttcaccatcaacagcctgcagcctgaggacgtggccacctacttttgccagcagtaccataacctgcctaccttcggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 501 - DNA, 723 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccaggacatcaccaactacctgacctggtatcagcagaagcccggcaacgcccctaagctgctgatctacgatgccagcaacctgcataccggcgtgcccagcagattttctggcagcggctctggcaccgacttcaccttcaccatcaacagcctgcagcctgaggacgtggccacctacttttgccagcagtacgacaacctgcctaccttcggcggaggcaccaaggtggaaatcaagaggacagtggccgccccaagcgtgttcatctttcccccttccgacgagcagctgaagtctggcaccgccagcgtggtgtgcctgctgaacaacttctaccctcgggaggccaaggtccagtggaaggtggataacgccctgcagtctggcaatagccaggagtccgtgaccgagcaggactctaaggatagcacatattccctgtctagcaccctgacactgagcaaggccgattacgagaagcacaaggtgtatgcctgtgaagtcacccatcaggggctgtcatcacccgtcactaagtcattcaatcgcggagaatgctgataagctt

SEQ ID NO: 502 - DNA, 723 bp, Artificial Sequence
  Description of Artificial Sequence: Synthetic polynucleotide
gaattcccgccgccaccatgggctggtcatgtattattctgtttctggtcgcaactgctacaggggtccatagtgacatccagatgacacagagccctagcagcctgtctgccagcgtgggagacagagtgaccattacctgtcaggccagccaggacatcaccaactacctgacctggtatcagcagaagcccggcaacgcccctaagctgctgatctacgatgccagcaacctggaaaccggcgtgcccagcagattttctggcagcggctctggcaccgacttcaccttcaccatcaacagcctgcagcctgaggacgtggccacctacttttgccagcagtacgacaacctgcctaccttcggcggaggcaccaaggtggaaatcaagagagccgacgccgcccctaccgtgtccatcttcccacctagctctgaacagctgaccagcggcggagccagcgtggtgtgcttcctgaacaacttctaccccaaggacatcaacgtgaagtggaagatcgacggcagcgagagacagaacggcgtgctgaatagctggaccgaccaggacagcaaggatagcacctacagcatgagcagcaccctgacactgaccaaggacgagtacgagcggcacaacagctacacatgcgaggccacacacaagaccagcacatctcctatcgtgaagagcttcaacagaaacgagtgctgataagctt

SEQ ID NO: 503 - DNA, 723 bp, Artificial Sequence; identical to SEQ ID NO: 497
  Description of Artificial Sequence: Synthetic polynucleotide

SEQ ID NO: 504 - DNA, 726 bp, Artificial Sequence
  Description of Artificial Sequence: Synthetic polynucleotide
gaattcccgccgccaccatgggctggtcctgcatcatcctgttcctggtggccacagccaccggcgtgcacagcgagatcgtgctgacccagagccccgatttccagagcgtgacccctaaggaaaaggtgaccatcacctgcagagccagccagtccataggatctagcctgcactggtaccagcagaaacctgatcagtctccaaagctgctgatcaagtacgcctctcagagcatcagcggcgtgcccagcagattcagcggcagcggctctggcaccgacttcaccctgacaatcaacagcctggaagccgaggacgccgctgcctactactgccaccagagcagcagcctgcctcagaccttcggccagggcacaaaggtggaaatcaagagaaccgtggccgcccctagcgtgttcatcttcccccccagcgacgagcagctgaagagcggtacagcttctgtggtgtgcctgctgaacaacttctacccgcgggaagccaaggtgcagtggaaggtggacaacgccctgcagagcggcaacagccaggagagcgtgacagagcaggacagcaaggacagcacctacagcctgagcagcaccctgaccctgagcaaggccgactacgagaagcacaaggtgtacgcctgtgaagtgacccaccagggcctgtctagccctgtgaccaagtcttttaacagaggcgagtgctgataagctt

SEQ ID NO: 505 - DNA, 1449 bp, Artificial Sequence
  Description of Artificial Sequence: Synthetic polynucleotide
gaattcccgccgccaccatgggctggtcatgcattattctgtttctggtcgcaactgctacaggcgtgcatagtcaggtgcagctggttgaatctggtggcggagttgtgcagcctggcagaagcctgagactgtcttgtgccgccagcggcttcacctttagcagctatggcatgcactgggtccgacaggcccctggcaaaggacttgaatgggtcgccgacatttggtacgacggcagcaacaagcactacgccgacagcgtgaagggcagattcaccatcagccgggacaacagcaagaacaccctgtacctgcagatgaacagcctgagagccgaggacaccgccgtgtactattgtgccagagagagcgactacgagcggccctacttctactacggcatggatgtgtggggccagggcaccacagtgacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 506 - DNA, 1449 bp, Artificial Sequence
  Description of Artificial Sequence: Synthetic polynucleotide
gaattcccgccgccaccatgggctggtcatgcattattctgtttctggtcgcaactgctacaggcgtgcatagtcaggtgcagctggttgaatctggtggcggagttgtgcagcctggcagaagcctgagactgtcttgtgccgccagcggcttcacctttagcagctatggcatgcactgggtccgacaggcccctggcaaaggacttgaatgggtcgccgacatttggtacgacggcagcaacaagcactacgccgacagcgtgaagggcagattcaccatcagccgggacaacagcaagaacaccctgtacctgcagatgaacagcctgagagccgaggacaccgccgtgtactattgtgccagagagagcgactacgagcggccctacttctactacggcatggatgtgtggggccagggcaccacagtgacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgctgcacgaagccctgcattcccactatactcagaaatccctgtccctgtcacctggaaagtgataagctt

SEQ ID NO: 507 - DNA, 1446 bp, Artificial Sequence
  Description of Artificial Sequence: Synthetic polynucleotide
gaattcccgccgccaccatgggctggtcatgcattattctgtttctggtcgcaactgctacaggcgtgcatagtcaggtgcagctggttgaatctggtggcggagttgtgcagcctggcagaagcctgagactgtcttgtgccgccagcggcttcacctttagcagctatggcatgcactgggtccgacaggcccctggcaaaggacttgaatgggtcgccgacatttggtacgacggcagcaacaagcactacgccgacagcgtgaagggcagattcaccatcagccgggacaacagcaagaacaccctgtacctgcagatgaacagcctgagagccgaggacaccgccgtgtactattgtgccagagagagcgactacgagcggccctacttctactacggcatggatgtgtggggccagggcaccacagtgacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 508 - DNA, 1449 bp, Artificial Sequence
  Description of Artificial Sequence: Synthetic polynucleotide
gaattcccgccgccaccatgggctggtcatgcattattctgtttctggtcgcaactgctacaggcgtgcatagtcaggtgcagctggttgaatctggtggcggagttgtgcagcctggcagaagcctgagactgtcttgtgccgccagcggcttcacctttagcagctatggcatgcactgggtccgacaggcccctggcaaaggacttgaatgggtcgccgacatttggtacgacggcagcaacaagcactacgccgacagcgtgaagggcagattcaccatcagccgggacaacagcaagaacaccctgtacctgcagatgaacagcctgagagccgaggacaccgccgtgtactattgtgccagagagagcgactacgagcggccctacttctactacggcatggatgtgtggggccagggcaccacagtgacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgtatatcacccgggagcccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 509 - DNA, 1446 bp, Artificial Sequence
  Description of Artificial Sequence: Synthetic polynucleotide
gaattcccgccgccaccatgggctggtcatgcattattctgtttctggtcgcaactgctacaggcgtgcatagtcaggtgcagctggttgaatctggtggcggagttgtgcagcctggcagaagcctgagactgtcttgtgccgccagcggcttcacctttagcagctatggcatgcactgggtccgacaggcccctggcaaaggacttgaatgggtcgccgacatttggtacgacggcagcaacaagcactacgccgacagcgtgaagggcagattcaccatcagccgggacaacagcaagaacaccctgtacctgcagatgaacagcctgagagccgaggacaccgccgtgtactattgtgccagagagagcgactacgagcggccctacttctactacggcatggatgtgtggggccagggcaccacagtgacagtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 510 - DNA, 1446 bp, Artificial Sequence
  Description of Artificial Sequence: Synthetic polynucleotide
gaattcccgccgccaccatgggctggtcatgcattattctgtttctggtcgcaactgctacaggcgtgcatagtcaggtgcagctggttgaatctggtggcggagttgtgcagcctggcagaagcctgagactgtcttgtgccgccagcggcttcacctttagcagctatggcatgcactgggtccgacaggcccctggcaaaggacttgaatgggtcgccgacatttggtacgacggcagcaacaagcactacgccgacagcgtgaagggcagattcaccatcagccgggacaacagcaagaacaccctgtacctgcagatgaacagcctgagagccgaggacaccgccgtgtactattgtgccagagagagcgactacgagcggccctacttctactacggcatggatgtgtggggccagggcaccacagtgacagtctcgagtgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacctgctgggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagctt

SEQ ID NO: 511 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccagtgctccctgaagctgaacagcgtgaccacagccgataccgccgtgtactactgcgccagacatcccgtggccatgaacttcgatgattggggccagggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 512 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccagtgctccctgaagctgaacagcgtgaccacagccgataccgccgtgtactactgcgccagacatcccgtggccatgaacttcgatgattggggccagggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgaggcggcgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 513 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccagtgctccctgaagctgaacagcgtgaccacagccgataccgccgtgtactactgcgccagacatcccgtggccatgaacttcgatgattggggccagggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacgcctctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 514 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccagttctccctgaagctgaacagcgtgaccacagccgataccgccgtgtactactgcgccagacatcccgtggccatgaacttcgatgattggggccagggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 515 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccaggcctccctgaagctgaacagcgtgaccacagccgataccgccgtgtactactgcgccagacatcccgtggccatgaacttcgatgattggggccagggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 516 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccagtcctccctgaagctgaacagcgtgaccacagccgataccgccgtgtactactgcgccagacatcccgtggccatgaacttcgatgattggggccagggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 517 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccaggcctccctgaagctgaacagcgtgaccacagccgataccgccgtgtactactgcgccagacatcccgtggccatgaacttcgatgattggggccagggcaccctggtcacagtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 518 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccaggcctccctgaagctgaacagcgtgaccacagccgataccgccgtgtactactgcgccagacatcccgtggccatgaacttcgatgattggggccagggcaccctggtcacagtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgctgcacgaagccctgcattcccactatactcagaaatccctgtccctgtcacctggaaagtgataagctt

SEQ ID NO: 519 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccaggcctccctgaagctgaacagcgtgaccacagccgataccgccgtgtactactgcgccagacatcccgtggccatgaacttcgatgattggggccagggcaccctggtcacagtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgtatatcacccgggagcccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 520 - DNA, 1428 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtacagtgtctggcggcagcatcagcagcagcggctattactggggctggatcagacagcctcctggcaaaggcctggaatggatcggcagcctgtacagctctggctacacctactacaaccccagcctgaagtccagagtgaccatcagcgtggacaccagcaagaaccaggcctccctgaagctgaacagcgtgaccacagccgataccgccgtgtactactgcgccagacatcccgtggccatgaacttcgatgattggggccagggcaccctggtcacagtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 521 - DNA, 1431 bp, Artificial Sequence
  Description of Artificial Sequence: Synthetic polynucleotide
gaattcccgccgccaccatgggctggtcctgcatcatcctgttcctggtcgccaccgccacaggagtgcacagccaactgcagctgcaggagagcggacctggcctggtcaagcctagcgagacactgagcctcacctgtaccgtgtctggcggatctatcagcagctccggctactattggggctggatccggcagcctccaggcaagggcctggaatggatcggcagcctgtacagctctggatacacctactacaaccccagcctgaaaagcagagtgaccatctctgtggacaccagcaagaaccaggccagcctgaagctgaatagcgtgaccaccgctgatacagccgtgtactactgcgccagacaccccgtggccatgaacttcgacgactggggccagggcacactggtgacagtgtcctccgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacctgctgggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagctt

SEQ ID NO: 522 - DNA, 1428 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtgtctagtgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 523 - DNA, 1428 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtgtctagtgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgctgcacgaagccctgcattcccactatactcagaaatccctgtccctgtcacctggaaagtgataagctt

SEQ ID NO: 524 - DNA, 1428 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtgtctagtgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgtatatcacccgggagcccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 525 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtgtctagtgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 526 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 527 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagccattactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 528 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctaccattggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 529 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggccatatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 530 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatccattacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 531 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctaccatagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 532 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcacccattacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 533 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaaccataaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 534 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactaccatcccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 535 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagacatatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 536 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttccatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 537 - DNA, 1428 bp, Artificial Sequence
  Description of Artificial Sequence: Synthetic polynucleotide
gaattcccgccgccaccatgggctggtcctgcatcatcctgttcctggtcgccaccgccacaggagtgcacagccaggtgcagctgcaggagagcggccctggcctggtgaaacctagtgaaaccctcagcctgacctgcaccgtgtccggaggatctatctctagctactactggagctggatcagacagcctcctggaaagggcctggaatggatcggctacatctactattctggcagcaccaactacaatcctagcctgaaaagccgggtgacaatcagcgtggacaccagcaagagccaattttctctgaagctgagcagcgtgaccgccgctgataccgccgtgtactactgcgccagagatatccccgcctttgccttcgacatctggggccagggcaccatggtcatcgtgtcctccgccgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacctgctgggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagctt

SEQ ID NO: 538 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacctgctgggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagctt

SEQ ID NO: 539 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacgccgccggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagctt

SEQ ID NO: 540 - DNA, 1419 bp, Artificial Sequence
  Description of Artificial Sequence: Synthetic polynucleotide
gaattcccgccgccaccatgggctggtcttgtattattctgtttctggtcgcaactgctacaggcgtgcattctcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtgtctagtgctgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctagctgtcctgctccagagtttctgggcggcccttccgtgttcctgtttccacccaaaccaaaggacacactgatgatctctagaacaccagaggtgacctgcgtggtggtggacgtgagccaggaggatcccgaggtgcagttcaactggtacgtggatggcgtggaggtgcacaatgccaagaccaagccaagagaggagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgatgcacgaagccctgcataatcactatactcagaaaagtctgtcactgtcactgggaaagtgataagctt

SEQ ID NO: 541 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtgtcatctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 542 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtgtcatctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgctgcacgaagccctgcattcccactatactcagaaatccctgtccctgtcacctggaaagtgataagctt

SEQ ID NO: 543 - DNA, 1428 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtgtcatctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 544 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtgtcatctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgaggcggcgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 545 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtgtcatctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgtatatcacccgggagcccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 546 - DNA, 1428 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 547 - DNA, 1428 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtctcgagtgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacctgctgggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagctt

SEQ ID NO: 548 - DNA, 1422 bp, Artificial Sequence
  Description of Artificial Sequence: Synthetic polynucleotide
gaattcccgccgccaccatgggctggtcttgtattattctgtttctggtcgcaactgctacaggcgtgcattctgaggtgcagctggttgaatctggcggcggactgattcagcctggcggcagcctgagattttcttgtgccgccagcggcttcaccttcagcagctacgccatgaactgggtccgacaggcccctggcaaaggccttgaatgggtgtccgccatctctggctctggcggcatcacctactacgccgattctgtgaagggcagattcaccatcagccgggacaacagcaagaacaccctgtacctgcagatgaactccctgagagccgaggacaccgccgtgtactactgtgccagagactgggagctgggccgctttgattattggggccagggcacactggtcaccgtgtcatctgctgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctagctgtcctgctccagagtttctgggcggcccttccgtgttcctgtttccacccaaaccaaaggacacactgatgatctctagaacaccagaggtgacctgcgtggtggtggacgtgagccaggaggatcccgaggtgcagttcaactggtacgtggatggcgtggaggtgcacaatgccaagaccaagccaagagaggagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgatgcacgaagccctgcataatcactatactcagaaaagtctgtcactgtcactgggaaagtgataagctt

SEQ ID NO: 549 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggaggactggttcagcctggcggatctctgagactgtcttgtgccgccagcggcttcacctttagcagctacgccatgagctgggtccgacaggctcctggcaaaggccttgaatgggtgtccgtgatctctggctctggcggcatcacctactacagcgactctgtgaagggcagattcaccatcagccgggacaacagcaagaacaccctgtacctgcagatgaacagcctgagagccgaggacaccgccgtgtactactgtgccaaggactgggagttcttctggtacttcgacctgtggggcagaggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 550 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggaggactggttcagcctggcggatctctgagactgtcttgtgccgccagcggcttcacctttagcagctacgccatgagctgggtccgacaggctcctggcaaaggccttgaatgggtgtccgtgatctctggctctggcggcatcacctactacagcgactctgtgaagggcagattcaccatcagccgggacaacagcaagaacaccctgtacctgcagatgaacagcctgagagccgaggacaccgccgtgtactactgtgccaaggactgggagttcttctggtacttcgacctgtggggcagaggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgctgcacgaagccctgcattcccactatactcagaaatccctgtccctgtcacctggaaagtgataagctt

SEQ ID NO: 551 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggaggactggttcagcctggcggatctctgagactgtcttgtgccgccagcggcttcacctttagcagctacgccatgagctgggtccgacaggctcctggcaaaggccttgaatgggtgtccgtgatctctggctctggcggcatcacctactacagcgactctgtgaagggcagattcaccatcagccgggacaacagcaagaacaccctgtacctgcagatgaacagcctgagagccgaggacaccgccgtgtactactgtgccaaggactgggagttcttctggtacttcgacctgtggggcagaggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 552 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggaggactggttcagcctggcggatctctgagactgtcttgtgccgccagcggcttcacctttagcagctacgccatgagctgggtccgacaggctcctggcaaaggccttgaatgggtgtccgtgatctctggctctggcggcatcacctactacagcgactctgtgaagggcagattcaccatcagccgggacaacagcaagaacaccctgtacctgcagatgaacagcctgagagccgaggacaccgccgtgtactactgtgccaaggactgggagttcttctggtacttcgacctgtggggcagaggcaccctggtcacagttagttctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgtatatcacccgggagcccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 553 - DNA, 1431 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggaggactggttcagcctggcggatctctgagactgtcttgtgccgccagcggcttcacctttagcagctacgccatgagctgggtccgacaggctcctggcaaaggccttgaatgggtgtccgtgatctctggctctggcggcatcacctactacagcgactctgtgaagggcagattcaccatcagccgggacaacagcaagaacaccctgtacctgcagatgaacagcctgagagccgaggacaccgccgtgtactactgtgccaaggactgggagttcttctggtacttcgacctgtggggcagaggcaccctggtcacagtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 554 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtgaggtgcagctggttgaatctggcggaggactggttcagcctggcggatctctgagactgtcttgtgccgccagcggcttcacctttagcagctacgccatgagctgggtccgacaggctcctggcaaaggccttgaatgggtgtccgtgatctctggctctggcggcatcacctactacagcgactctgtgaagggcagattcaccatcagccgggacaacagcaagaacaccctgtacctgcagatgaacagcctgagagccgaggacaccgccgtgtactactgtgccaaggactgggagttcttctggtacttcgacctgtggggcagaggcaccctggtcacagtctcgagtgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacctgctgggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagcttgtt

SEQ ID NO: 555 - DNA, 1437 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 556 - DNA, 1437 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgaggcggcgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 557 - DNA, 1437 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacgcctctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 558 - DNA, 1437 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgtatatcacccgggagcccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 559 - DNA, 1437 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgctgcacgaagccctgcattcccactatactcagaaatccctgtccctgtcacctggaaagtgataagctt

SEQ ID NO: 560 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 561 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgatgatctcccggacacccgaggtgacctgcgtggtggtggacgtgtctcacgaggatcctgaggtgaagttcaactggtatgtggatggcgtggaggtgcacaatgccaagaccaagcccagagagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 562 - DNA, 1434 bp, Artificial Sequence
  Description of Artificial Sequence: Synthetic polynucleotide
gaattcccgccgccaccatgggctggtcatgcattattctgtttctggtcgcaactgctacaggcgtgcatagtcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgtctcgagtgccaagacaaccgcccctagcgtttaccccctggcccctgtgtgcggcgacaccaccggctcctccgtgacactgggatgtctggtgaagggctactttccagaacccgtgacgctgacctggaacagcggcagcctgagcagcggcgtgcataccttccctgccgtgctccagtctgatctgtacaccctgagcagcagcgtcacagtgaccagctctacatggccttctcagagcatcacctgtaatgtggcccaccccgccagcagcaccaaggtggacaagaaaatcgagcccagaggccccaccatcaagccttgtcctccatgtaaatgccccgctcctaacctgctgggcggccctagcgtctttatcttcccgcctaagatcaaagacgtgctgatgatcagcctgtctcctatagttacctgcgtggttgttgatgtgtccgaggacgaccccgacgtgcagatcagctggttcgtgaacaacgtggaagtgcacacagcccagacacagacccacagagaggattacaacagcaccctgagagtggtgtctgccctgcccatccagcaccaggactggatgtctggcaaagagttcaagtgcaaggtgaacaacaaggacctgcctgctcctatcgagcggaccatctctaagcccaagggctctgtgcgggccccacaggtgtacgtgctgcctcctcctgaggaagagatgaccaagaaacaggtgacgctgacatgcatggtgaccgacttcatgcctgaagatatctacgtggaatggacaaacaatggcaagaccgagctgaactacaagaacaccgagcctgtgctggacagcgacggcagctacttcatgtacagcaagctgagagtggaaaagaagaactgggtggaaagaaactcttatagctgcagcgtggtccacgagggcctgcacaaccaccacaccacaaagagcttcagcagaacccctggaaagtgataagctt

SEQ ID NO: 563 - DNA, 1428 bp, Artificial Sequence
  Description of Artificial Sequence: Synthetic polynucleotide
gaattcccgccgccaccatgggctggtcttgtattattctgtttctggtcgcaactgctacaggcgtgcattctcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctagctgtcctgctccagagtttctgggcggcccttccgtgttcctgtttccacccaaaccaaaggacacactgatgatctctagaacaccagaggtgacctgcgtggtggtggacgtgagccaggaggatcccgaggtgcagttcaactggtacgtggatggcgtggaggtgcacaatgccaagaccaagccaagagaggagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgatgcacgaagccctgcataatcactatactcagaaaagtctgtcactgtcactgggaaagtgataagctt

SEQ ID NO: 564 - DNA, 1425 bp, Artificial Sequence
  Description of Artificial Sequence: Synthetic polynucleotide
gaattcccgccgccaccatgggctggtcttgtattattctgtttctggtcgcaactgctacaggcgtgcattctcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctagctgtcctgctccagagtttctgggcggcccttccgtgttcctgtttccacccaaaccaaaggacacactgatgatctctagaacaccagaggtgacctgcgtggtggtggacgtgagccaggaggatcccgaggtgcagttcaactggtacgtggatggcgtggaggtgcacaatgccaagaccaagccaagagagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgatgcacgaagccctgcataatcactatactcagaaaagtctgtcactgtcactgggaaagtgataagctt

SEQ ID NO: 565 - DNA, 1428 bp, Artificial Sequence
  Description of Artificial Sequence: Synthetic polynucleotide
gaattcccgccgccaccatgggctggtcttgtattattctgtttctggtcgcaactgctacaggcgtgcattctcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctagctgtcctgctccagagtttctgggcggcccttccgtgttcctgtttccacccaaaccaaaggacacactgtatatcactagagagccagaggtgacctgcgtggtggtggacgtgagccaggaggatcccgaggtgcagttcaactggtacgtggatggcgtggaggtgcacaatgccaagaccaagccaagagaggagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgatgcacgaagccctgcataatcactatactcagaaaagtctgtcactgtcactgggaaagtgataagctt

SEQ ID NO: 566 - DNA, 1428 bp, Artificial Sequence
  Description of Artificial Sequence: Synthetic polynucleotide
gaattcccgccgccaccatgggctggtcttgtattattctgtttctggtcgcaactgctacaggcgtgcattctcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctccctgtcctgctccagagtttctgggcggcccttccgtgttcctgtttccacccaaaccaaaggacacactgatgatctctagaacaccagaggtgacctgcgtggtggtggacgtgagccaggaggatcccgaggtgcagttcaactggtacgtggatggcgtggaggtgcacaatgccaagaccaagccaagagaggagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgatgcacgaagccctgcataatcactatactcagaaaagtctgtcactgtcactgggaaagtgataagctt

SEQ ID NO: 567 - DNA, 1428 bp, Artificial Sequence
  Description of Artificial Sequence: Synthetic polynucleotide
gaattcccgccgccaccatgggctggtcttgtattattctgtttctggtcgcaactgctacaggcgtgcattctcagctccagctgcaagagtctggacctggcctggtcaagcctagcgagacactgagcctgacctgtatcgtgtctggcggcagcatcagcagcagcggctattactggggctggatcagacagcctcctggcaaaggcctggaatggatcggctccatcttctacagcggcaacacccactacaaccccagcctgaagtccagagtgacaatccccgtggacaccagcaagaaccagttctccctgaagctgagcagcgtgacagccgccgatagcgccgtgtactactgcgccagaagagacatcctgacaggcccctttgactactggggccagggaacactggtcaccgttagctctgctgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctagctgtcctgctccagagtttctgggcggcccttccgtgttcctgtttccacccaaaccaaaggacacactgatgatctctagaacaccagaggtgacctgcgtggtggtggacgtgagccaggaggatcccgaggtgcagttcaactggtacgtggatggcgtggaggtgcacaatgccaagaccaagccaagagaggagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgctgcacgaagccctgcattcccactatactcagaaaagtctgtcactgtcactgggaaagtgataagctt

SEQ ID NO: 568 - DNA, 1449 bp, Artificial Sequence
  Description of Artificial Sequence: Synthetic polynucleotide
gaattcccgccgccaccatgggctggtcctgtatcatcctgttcctggtcgccacagccaccggagtgcacagccaagtgcagctggtggaatctggcggaggcgtggtgcagcctggaagaagcctgagactgagctgcgccgccagcggcttcaccttcagcagctacggcatgcactgggtcagacaggcccctggcaagggcctggaatgggtggccgatatctggtacgacggcagcaacaagcactacgccgacagcgtgaagggcagattcaccatcagcagagataatagcaagaacaccctgtacctgcagatgaacagcctgcgggccgaggacacagccgtgtactactgcgccagagagagcgacgacgagcggccctacttctactacggcatggacgtgtggggccagggcaccaccgtgaccgtgtccagcgccgccagcaccaagggcccctctgtctttcctctggccccttctagcaaatctacaagcggaggcaccgccgccctgggttgtctggtgaaagactacttcccagagcctgtgaccgtgtcttggaacagcggcgccctgaccagcggcgtgcacacattccccgctgtgctgcagagcagcggcctgtacagcctgagcagcgtggtcaccgtccccagcagctctctgggaacacagacctacatctgcaacgtgaaccacaagccttctaataccaaggtggataagaaggtggaacctaagagttgcgacaagacccacacctgtcctccgtgccccgcccctgagctgctgggcggccctagcgtgtttctgttccctccaaagcccaaggacaccctgatgatcagcagaacccctgaggtgacctgcgtggtggttgatgtgtcccacgaagatcctgaggtgaagttcaactggtacgtggacggcgttgaggtgcataatgccaagacaaagccaagagaggaacagtacaacagcacatacagagtggtgtccgtgctgaccgtgctgcaccaggactggctgaacggcaaagagtacaagtgcaaggtgtccaacaaggccctgcctgctcctatcgagaagaccatcagcaaggctaaaggacagcctcgggaaccccaggtctacaccctgccccccagccgggacgagctgacaaagaaccaggtgtccctgacatgcctggtgaagggcttctacccctccgacatcgccgtggaatgggagagcaatggccaacctgaaaacaactacaaaacgacccctcctgttctggacagcgacggcagcttcttcctttatagcaagctgacagtggacaagagcagatggcagcagggcaacgtgttcagctgcagcgtgatgcacgaggccctccacaaccactacacccagaagtccctgagcctgtctcctggcaagtgataagctt

SEQ ID NO: 569 - protein, 233 aa, Artificial Sequence
  Description of Artificial Sequence: Synthetic polypeptide
MGWSCIILFLVATATGVHSDIQMTQSPSSLSASVGDRVTITCQASQDISNYLNWYQQKPGRAPELLIYDASNLETGVPSRFSGSGSGTDFTFTISSLQPEDFATYSCQQHDHLPWTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 570 - protein, 233 aa, Artificial Sequence
  Description of Artificial Sequence: Synthetic polypeptide
MGWSCIILFLVATATGVHSEIVLTQSPATLSLSPGERATLSCGASQSVSSNYLAWYQQKPGLAPRLLIYGASSRATGVPDRFSGSGSGTDFTLTISRLEPEDFAVYYCQQYGYSYTFGQGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 571 - protein, 232 aa, Artificial Sequence
  Description of Artificial Sequence: Synthetic polypeptide
MGWSCIILFLVATATGVHSDIQMTQSPSSLSASVGDRVTITCQASQDITNYLTWYQQKPGNAPKLLIYDASNLETGVPSRFSGSGSGTDFTFTINSLQPEDVATYFCQQYDNLPTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 572 - protein, 474 aa, Artificial Sequence
  Description of Artificial Sequence: Synthetic polypeptide
MGWSCIILFLVATATGVHSQVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 573 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 574 - protein, 463 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 575 - protein, 7 aa, Artificial Sequence
  Description of Artificial Sequence: Synthetic peptide
YASQSFS

SEQ ID NO: 576 - protein, 8 aa, Artificial Sequence
  Description of Artificial Sequence: Synthetic peptide
QSVNYYLA

SEQ ID NO: 577 - protein, 8 aa, Artificial Sequence
  Description of Artificial Sequence: Synthetic peptide
QSVSHYLA

SEQ ID NO: 578 - protein, 8 aa, Artificial Sequence
  Description of Artificial Sequence: Synthetic peptide
QSVSYHLA

SEQ ID NO: 579 - protein, 10 aa, Artificial Sequence
  Description of Artificial Sequence: Synthetic peptide
GFTFSSYGMH

SEQ ID NO: 580 - DNA, 1425 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttccactggccccctcctctaaatccacatctggcggcaccgccgccctgggctgtctggtgaaggactacttcccagagcctgtgacagtgtcctggaactctggcgccctgacatccggcgtgcacacatttccagccgtgctgcagagctccggcctgtacagcctgtctagcgtggtgacagtgccctcctctagcctgggcacacagacctatatctgcaacgtgaatcacaagccaagcaataccaaggtggacaagaaggtggagcccaagtcctgtgataagacacacacctgccccccttgtcctgctcccgagctgctgggcggccctagcgtgttcctgtttccacccaagcctaaggacaccctgtatatcacccgggagcccgaggtgacctgcgtggtggtggacgtgtctcacgaggatcctgaggtgaagttcaactggtatgtggatggcgtggaggtgcacaatgccaagaccaagcccagagaggagcagtacaactctacatatagggtggtgagcgtgctgaccgtgctgcaccaggactggctgaacggcaaggagtataagtgcaaggtgtccaataaggccctgcccgcccccatcgagaagacaatcagcaaggccaagggccagcctcgggagccacaggtgtacaccctgcctccatccagagacgagctgacaaagaaccaggtgtctctgacatgtctggtgaagggcttctatcctagcgatatcgccgtggagtgggagtccaatggccagccagagaacaattacaagaccacaccccctgtgctggactccgatggctccttctttctgtattccaagctgaccgtggataagtctcggtggcagcagggcaacgtgttcagctgttccgtgatgcacgaagccctgcataatcactatactcagaaatccctgtccctgtcacctggaaagtgataagctt

SEQ ID NO: 581 - DNA, 1416 bp, Artificial Sequence
  Description of Artificial Sequence: Synthetic polynucleotide
gaattcccgccgccaccatgggctggtcatgcattattctgtttctggtcgcaactgctacaggcgtgcatagtcaggttcagctgcaagagtctggccctggcctggtcaagcctagcgaaacactgagcctgacctgtaccgtgtctggcggcagcatcagcagctactactggtcctggatcagacagcctcctggcaaaggcctggaatggatcggctacatctactacagcggcagcaccaactacaaccccagcctgaagtccagagtgaccatcagcgtggacaccagcaagagccagttctccctgaagctgagcagcgtgacagccgccgatacagccgtgtactactgcgccagagacatccctgccttcgccttcgatatctggggccagggcacaatggtcatcgtctcgagtgccagcaccaagggcccttccgtgtttcccctggccccttgctcccggtccacatctgagagcaccgccgccctgggctgtctggtgaaggactacttcccagagcccgtgaccgtgagctggaacagcggcgccctgacaagcggcgtgcacacatttcccgccgtgctgcagagctccggcctgtactccctgtctagcgtggtgacagtgccttcctctagcctgggcaccaagacatatacctgtaacgtggaccacaagccaagcaataccaaggtggataagcgggtggagtctaagtacggccctccttgccctccctgtcctgctccagagtttctgggcggcccttccgtgttcctgtttccacccaaaccaaaggacacactgatgatctctagaacaccagaggtgacctgcgtggtggtggacgtgagccaggaggatcccgaggtgcagttcaactggtacgtggatggcgtggaggtgcacaatgccaagaccaagccaagagaggagcagtttaactctacatacagggtggtgagcgtgctgaccgtgctgcaccaggattggctcaacggcaaggagtataagtgcaaggtgtccaataagggcctgccctcctctatcgagaagacaatctctaaggctaagggccagccaagagagcctcaggtgtacaccctgcctccaagccaggaggagatgacaaagaaccaggtgtccctgacatgtctggtgaagggcttctatccctccgacatcgccgtggagtgggagtctaatggccagcctgagaacaattacaagaccacaccccctgtgctggactctgatggcagcttctttctgtattccaggctgaccgtggataagtctcggtggcaggagggcaacgtgttcagctgctctgtgatgcacgaagccctgcataatcactatactcagaaaagtctgtcactgtcactgggaaagtgataagctt

SEQ ID NO: 582 - DNA, 726 bp, Artificial Sequence; identical to SEQ ID NO: 482
  Description of Artificial Sequence: Synthetic polynucleotide

SEQ ID NO: 583 - DNA, 726 bp, Artificial Sequence; identical to SEQ ID NO: 482
  Description of Artificial Sequence: Synthetic polynucleotide

SEQ ID NO: 584 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSSA

SEQ ID NO: 585 - protein, 120 aa, Artificial Sequence
  Description of Artificial Sequence: Synthetic polypeptide
QLQLQESGPGLVKPSETLSLTCTVSGGSISSSGYYWGWIRQPPGKGLEWIGSLYSSGYTYYNPSLKSRVTISVDTSKNQCSLKLNSVTTADTAVYYCARHPVAMNFDDWGQGTLVTVSSA

SEQ ID NO: 586 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSSA

SEQ ID NO: 587 - protein, 119 aa, Artificial Sequence
  Description of Artificial Sequence: Synthetic polypeptide
EVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSSA

SEQ ID NO: 588 - protein, 120 aa, Artificial Sequence
  Description of Artificial Sequence: Synthetic polypeptide
EVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSSA

SEQ ID NO: 589 - protein, 121 aa, Artificial Sequence
  Description of Artificial Sequence: Synthetic polypeptide
QLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSSA

SEQ ID NO: 590 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVADIWYDGSNKHYADSVKGRFTISRDNSKNTLYLQMNSLRAEDTAVYYCARESDYERPYFYYGMDVWGQGTTVTVSS

SEQ ID NO: 591 - protein, 119 aa, Artificial Sequence
  Description of Artificial Sequence: Synthetic polypeptide
QLQLQESGPGLVKPSETLSLTCTVSGGSISSSGYYWGWIRQPPGKGLEWIGSLYSSGYTYYNPSLKSRVTISVDTSKNQCSLKLNSVTTADTAVYYCARHPVAMNFDDWGQGTLVTVSS

SEQ ID NO: 592 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPAFAFDIWGQGTMVIVSS

SEQ ID NO: 593 - protein, 118 aa, Artificial Sequence
  Description of Artificial Sequence: Synthetic polypeptide
EVQLVESGGGLIQPGGSLRFSCAASGFTFSSYAMNWVRQAPGKGLEWVSAISGSGGITYYADSVKGRFTISRDNSKNTLYLQMNSLRAEDTAVYYCARDWELGRFDYWGQGTLVTVSS

SEQ ID NO: 594 - protein, 119 aa, Artificial Sequence
  Description of Artificial Sequence: Synthetic polypeptide
EVQLVESGGGLVQPGGSLRLSCAASGFTFSSYAMSWVRQAPGKGLEWVSVISGSGGITYYSDSVKGRFTISRDNSKNTLYLQMNSLRAEDTAVYYCAKDWEFFWYFDLWGRGTLVTVSS

SEQ ID NO: 595 - protein, 120 aa, Artificial Sequence
  Description of Artificial Sequence: Synthetic polypeptide
QLQLQESGPGLVKPSETLSLTCIVSGGSISSSGYYWGWIRQPPGKGLEWIGSIFYSGNTHYNPSLKSRVTIPVDTSKNQFSLKLSSVTAADSAVYYCARRDILTGPFDYWGQGTLVTVSS

SEQ ID NO: 596 - protein, 117 aa, Artificial Sequence
  Description of Artificial Sequence: Synthetic polypeptide
QVQLQESGPGLVKPSETLSLTCTVSGGSISSHYWSWIRQPPGKGLEWIGYIYYSGSTNYNPSLKSRVTISVDTSKSQFSLKLSSVTAADTAVYYCARDIPAFAFDIWGQGTMVIVSS

SEQ ID NO: 597 - protein, 117 aa, Artificial Sequence
  Description of Artificial Sequence: Synthetic polypeptide
QVQLQESGPGLVKPSETLSLTCTVSGGSISSYHWSWIRQPPGKGLEWIGYIYYSGSTNYNPSLKSRVTISVDTSKSQFSLKLSSVTAADTAVYYCARDIPAFAFDIWGQGTMVIVSS

SEQ ID NO: 598 - protein, 233 aa, Artificial Sequence
  Description of Artificial Sequence: Synthetic polypeptide
MGWSCIILFLVATATGVHSEIVLTQSPATLSLSPGERATLSCRASQSVSYYLAWYQQKPGQAPRLLIYDAFNRATGIPARFSGSGSGTDFTLTISSLEPEDFAVYYCQQRINWPLPFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 599 - protein, 233 aa, Artificial Sequence; identical to SEQ ID NO: 391
  Description of Artificial Sequence: Synthetic polypeptide

SEQ ID NO: 600 - protein, 233 aa, Artificial Sequence; identical to SEQ ID NO: 391
  Description of Artificial Sequence: Synthetic polypeptide

SEQ ID NO: 601 - protein, 233 aa, Artificial Sequence; identical to SEQ ID NO: 391
  Description of Artificial Sequence: Synthetic polypeptide

SEQ ID NO: 602 - protein, 233 aa, Artificial Sequence; identical to SEQ ID NO: 391
  Description of Artificial Sequence: Synthetic polypeptide

SEQ ID NO: 603 - protein, 233 aa, Artificial Sequence
  Description of Artificial Sequence: Synthetic polypeptide
MGWSCIILFLVATATGVHSEIVLTQSPATLSLSPGERATLSCRASQSVNYYLAWYQQKPGQAPRLLIYDAFNRATGIPARFSGSGSGTDFTLTISSLEPEDFAVYYCQQRISWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 604 - protein, 466 aa, Artificial Sequence; identical to SEQ ID NO: 429
  Description of Artificial Sequence: Synthetic polypeptide

SEQ ID NO: 605 - protein, 466 aa, Artificial Sequence
  Description of Artificial Sequence: Synthetic polypeptide
MGWSCIILFLVATATGVHSQVQLQESGPGLVKPSETLSLTCTVSGGSVSSYYWSWIRQPPGKGLEWIGYIYYSGSTNYNPSLKSRVTISVDTSKSQFSLKLGSVTAADTAGYYCARDIPAFAFEIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 606 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRKPPGKGLEWIGYIYYSGSTNYNPSLKSRVTISVDTSKSQFSLKLSSVTAADTAVYYCARDIPAFALDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 607 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCARDIPASAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 608 - protein, 466 aa, Artificial Sequence
  Description of Artificial Sequence: Synthetic polypeptide
MGWSCIILFLVATATGVHSQVQLQESGPGLVKPSETLSLTCTVSGGSISSYYWSWIRQPPGKGLEWIGYIYYSGSTNYNPSLKSRVTISVDTSKSQFSLKLSSVTAADTAVYYCASDIPAFAFDIWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 466 aa, Artificial Sequence; identical to SEQ ID NO: 429
  Description of Artificial Sequence: Synthetic polypeptide

SEQ ID NO: 610 - DNA, 1425 bp, Artificial Sequence
  Description of Artificial Sequence: Synthetic polynucleotide
gaattcccgccgccaccatgggctggtcctgtatcatcctgttcctggtcgccacagccaccggagtgcacagccaagtgcagctgcaggagagcggacctggcctggtgaagcctagcgagacactgtctctgacctgtaccgtgtctggcggatctatcagcagctactattggtcctggatccggcagccccccggcaagggcctggaatggatcggctacatctactacagcggcagcaccaactacaacccaagcctcaagtctagagtgaccatcagcgtggacacaagcaagtcccagttcagcctgaaactgagcagcgtcaccgccgctgatacagccgtgtactactgcgccagagacattcctgcctttgccttcgacatctggggccagggcaccatggtgatcgtgtccagcgccagcaccaagggcccctctgtctttcctctggccccttctagcaaatctacaagcggaggcaccgccgccctgggttgtctggtgaaagactacttcccagagcctgtgaccgtgtcttggaacagcggcgccctgaccagcggcgtgcacacattccccgctgtgctgcagagcagcggcctgtacagcctgagcagcgtggtcaccgtccccagcagctctctgggaacacagacctacatctgcaacgtgaaccacaagccttctaataccaaggtggataagaaggtggaacctaagagttgcgacaagacccacacctgtcctccgtgccccgcccctgagctgctgggcggccctagcgtgtttctgttccctccaaagcccaaggacaccctgatgatcagcagaacccctgaggtgacctgcgtggtggttgatgtgtcccacgaagatcctgaggtgaagttcaactggtacgtggacggcgttgaggtgcataatgccaagacaaagccaagagaggaacagtacaacagcacatacagagtggtgtccgtgctgaccgtgctgcaccaggactggctgaacggcaaagagtacaagtgcaaggtgtccaacaaggccctgcctgctcctatcgagaagaccatcagcaaggctaaaggacagcctcgggaaccccaggtctacaccctgccccccagccgggacgagctgacaaagaaccaggtgtccctgacatgcctggtgaagggcttctacccctccgacatcgccgtggaatgggagagcaatggccaacctgaaaacaactacaaaacgacccctcctgttctggacagcgacggcagcttcttcctttatagcaagctgacagtggacaagagcagatggcagcagggcaacgtgttcagctgcagcgtgatgcacgaggccctccacaaccactacacccagaagtccctgagcctgtctcctggcaagtgataagctt

SEQ ID NO: 611 - DNA, 1425 bp, Artificial Sequence
  Description of Artificial Sequence: Synthetic polynucleotide
gaattcccgccgccaccatgggctggtcctgtatcatcctgttcctggtcgccacagccaccggagtgcacagccaagtgcagctgcaggagagcggacctggcctggtgaagcctagcgagacactgagcctgacctgtaccgtgtctggcggatctgtttctagctactactggtcctggattcggcagccccccggcaagggcctggaatggatcggctacatctactacagcggcagcaccaactacaacccatctctcaagagcagagtgacaatcagcgtcgacaccagcaagtcccagttcagcctgaaactgggcagcgtgaccgccgctgatacagccggatattactgcgccagagacatccctgcctttgccttcgaaatctggggccagggcaccatggtgatcgtgtccagcgccagcaccaagggcccctctgtctttcctctggccccttctagcaaatctacaagcggaggcaccgccgccctgggttgtctggtgaaagactacttcccagagcctgtgaccgtgtcttggaacagcggcgccctgaccagcggcgtgcacacattccccgctgtgctgcagagcagcggcctgtacagcctgagcagcgtggtcaccgtccccagcagctctctgggaacacagacctacatctgcaacgtgaaccacaagccttctaataccaaggtggataagaaggtggaacctaagagttgcgacaagacccacacctgtcctccgtgccccgcccctgagctgctgggcggccctagcgtgtttctgttccctccaaagcccaaggacaccctgatgatcagcagaacccctgaggtgacctgcgtggtggttgatgtgtcccacgaagatcctgaggtgaagttcaactggtacgtggacggcgttgaggtgcataatgccaagacaaagccaagagaggaacagtacaacagcacatacagagtggtgtccgtgctgaccgtgctgcaccaggactggctgaacggcaaagagtacaagtgcaaggtgtccaacaaggccctgcctgctcctatcgagaagaccatcagcaaggctaaaggacagcctcgggaaccccaggtctacaccctgccccccagccgggacgagctgacaaagaaccaggtgtccctgacatgcctggtgaagggcttctacccctccgacatcgccgtggaatgggagagcaatggccaacctgaaaacaactacaaaacgacccctcctgttctggacagcgacggcagcttcttcctttatagcaagctgacagtggacaagagcagatggcagcagggcaacgtgttcagctgcagcgtgatgcacgaggccctccacaaccactacacccagaagtccctgagcctgtctcctggcaagtgataagctt

SEQ ID NO: 612 - DNA, 1425 bp, Artificial Sequence
  Description of Artificial Sequence: Synthetic polynucleotide
gaattcccgccgccaccatgggctggtcctgtatcatcctgttcctggtcgccacagccaccggagtgcacagccaagtgcagctgcaggagagcggacctggactcgtgaagcctagcgagacactgtctctgacctgtaccgtgtccggcggcagcatcagcagctactattggtcctggatccggaagccccccggcaagggcctggaatggatcggctacatctactacagcggctctacaaactacaacccaagcctgaagtccagagtgaccatctctgtggacaccagcaagagccagttcagcctgaaactgagcagcgtgacagccgccgacaccgccgtgtactactgcgccagagatattcctgctttcgccctggacatctggggccagggcaccatggtcaccgtgtctagcgccagcaccaagggcccctctgtctttcctctggccccttctagcaaatctacaagcggaggcaccgccgccctgggttgtctggtgaaagactacttcccagagcctgtgaccgtgtcttggaacagcggcgccctgaccagcggcgtgcacacattccccgctgtgctgcagagcagcggcctgtacagcctgagcagcgtggtcaccgtccccagcagctctctgggaacacagacctacatctgcaacgtgaaccacaagccttctaataccaaggtggataagaaggtggaacctaagagttgcgacaagacccacacctgtcctccgtgccccgcccctgagctgctgggcggccctagcgtgtttctgttccctccaaagcccaaggacaccctgatgatcagcagaacccctgaggtgacctgcgtggtggttgatgtgtcccacgaagatcctgaggtgaagttcaactggtacgtggacggcgttgaggtgcataatgccaagacaaagccaagagaggaacagtacaacagcacatacagagtggtgtccgtgctgaccgtgctgcaccaggactggctgaacggcaaagagtacaagtgcaaggtgtccaacaaggccctgcctgctcctatcgagaagaccatcagcaaggctaaaggacagcctcgggaaccccaggtctacaccctgccccccagccgggacgagctgacaaagaaccaggtgtccctgacatgcctggtgaagggcttctacccctccgacatcgccgtggaatgggagagcaatggccaacctgaaaacaactacaaaacgacccctcctgttctggacagcgacggcagcttcttcctttatagcaagctgacagtggacaagagcagatggcagcagggcaacgtgttcagctgcagcgtgatgcacgaggccctccacaaccactacacccagaagtccctgagcctgtctcctggcaagtgataagctt

SEQ ID NO: 613 - DNA, 1425 bp, Artificial Sequence
  Description of Artificial Sequence: Synthetic polynucleotide
gaattcccgccgccaccatgggctggtcctgtatcatcctgttcctggtcgccacagccaccggagtgcacagccaagtgcagctgcaggagagcggccctggcctggtgaagcctagcgagacactgtctctcacctgtaccgtgtccggcggcagcatcagcagctactactggtcctggatccggcagcctccaggaaagggcctggaatggattggatatatctactacagcggctctacaaactacaaccccagcctgaaaagcagagtgacaatctctgtggacaccagcaagtcccagttcagcctgaagctgagcagcgtgaccgccgctgataccgccgtgtactactgcgccagagacatccccgccagcgccttcgacatctggggccagggcaccatggtcatcgtgtctagcgccagcaccaagggcccctctgtctttcctctggccccttctagcaaatctacaagcggaggcaccgccgccctgggttgtctggtgaaagactacttcccagagcctgtgaccgtgtcttggaacagcggcgccctgaccagcggcgtgcacacattccccgctgtgctgcagagcagcggcctgtacagcctgagcagcgtggtcaccgtccccagcagctctctgggaacacagacctacatctgcaacgtgaaccacaagccttctaataccaaggtggataagaaggtggaacctaagagttgcgacaagacccacacctgtcctccgtgccccgcccctgagctgctgggcggccctagcgtgtttctgttccctccaaagcccaaggacaccctgatgatcagcagaacccctgaggtgacctgcgtggtggttgatgtgtcccacgaagatcctgaggtgaagttcaactggtacgtggacggcgttgaggtgcataatgccaagacaaagccaagagaggaacagtacaacagcacatacagagtggtgtccgtgctgaccgtgctgcaccaggactggctgaacggcaaagagtacaagtgcaaggtgtccaacaaggccctgcctgctcctatcgagaagaccatcagcaaggctaaaggacagcctcgggaaccccaggtctacaccctgccccccagccgggacgagctgacaaagaaccaggtgtccctgacatgcctggtgaagggcttctacccctccgacatcgccgtggaatgggagagcaatggccaacctgaaaacaactacaaaacgacccctcctgttctggacagcgacggcagcttcttcctttatagcaagctgacagtggacaagagcagatggcagcagggcaacgtgttcagctgcagcgtgatgcacgaggccctccacaaccactacacccagaagtccctgagcctgtctcctggcaagtgataagctt

SEQ ID NO: 614 - DNA, 1425 bp, Artificial Sequence
  Description of Artificial Sequence: Synthetic polynucleotide
gaattcccgccgccaccatgggctggtcctgtatcatcctgttcctggtcgccacagccaccggagtgcacagccaagtgcagctgcaggagagcggacctggcctggtgaagcctagcgagacactgtctctcacatgtaccgtgtccggcggcagcatcagcagctactactggtcctggatccggcagcctccaggcaagggcctggaatggattggatatatctactacagcggctccaccaactacaaccccagcctgaaatctagagtgacaatctctgtggacaccagcaagagccagttcagcctgaagctgagcagcgtgaccgccgctgataccgccgtgtactactgcgccagcgacatccccgcctttgccttcgacatctggggccagggcaccatggtcatcgtgtctagcgccagcaccaagggcccctctgtctttcctctggccccttctagcaaatctacaagcggaggcaccgccgccctgggttgtctggtgaaagactacttcccagagcctgtgaccgtgtcttggaacagcggcgccctgaccagcggcgtgcacacattccccgctgtgctgcagagcagcggcctgtacagcctgagcagcgtggtcaccgtccccagcagctctctgggaacacagacctacatctgcaacgtgaaccacaagccttctaataccaaggtggataagaaggtggaacctaagagttgcgacaagacccacacctgtcctccgtgccccgcccctgagctgctgggcggccctagcgtgtttctgttccctccaaagcccaaggacaccctgatgatcagcagaacccctgaggtgacctgcgtggtggttgatgtgtcccacgaagatcctgaggtgaagttcaactggtacgtggacggcgttgaggtgcataatgccaagacaaagccaagagaggaacagtacaacagcacatacagagtggtgtccgtgctgaccgtgctgcaccaggactggctgaacggcaaagagtacaagtgcaaggtgtccaacaaggccctgcctgctcctatcgagaagaccatcagcaaggctaaaggacagcctcgggaaccccaggtctacaccctgccccccagccgggacgagctgacaaagaaccaggtgtccctgacatgcctggtgaagggcttctacccctccgacatcgccgtggaatgggagagcaatggccaacctgaaaacaactacaaaacgacccctcctgttctggacagcgacggcagcttcttcctttatagcaagctgacagtggacaagagcagatggcagcagggcaacgtgttcagctgcagcgtgatgcacgaggccctccacaaccactacacccagaagtccctgagcctgtctcctggcaagtgataagctt

SEQ ID NO: 615 - DNA, 726 bp, Artificial Sequence
  Description of Artificial Sequence: Synthetic polynucleotide
gaattcccgccgccaccatgggctggtcctgcatcatcctgttcctggtggccacagccaccggcgtgcacagcgagatcgtgctgacccagtccccagctaccctcagcctgagccctggagagcgggccaccctgtcttgtagagccagccagagcgtgtcctactacctggcctggtatcagcagaaacctggccaggcccctagactgctgatctacgacgcctttaaccgggccacaggcatccccgctagattcagcggctctggcagcggcaccgatttcaccctgacaatcagcagcctggaacccgaggacttcgccgtctactactgccagcaaagaatcaactggcctctgcctttcggcggaggcacaaaggtggaaattaagagaaccgtggccgcccctagcgtgttcatcttcccccccagcgacgagcagctgaagagcggtacagcttctgtggtgtgcctgctgaacaacttctacccgcgggaagccaaggtgcagtggaaggtggacaacgccctgcagagcggcaacagccaggagagcgtgacagagcaggacagcaaggacagcacctacagcctgagcagcaccctgaccctgagcaaggccgactacgagaagcacaaggtgtacgcctgtgaagtgacccaccagggcctgtctagccctgtgaccaagtcttttaacagaggcgagtgctgataagctt

SEQ ID NO: 616 - DNA, 726 bp, Artificial Sequence
  Description of Artificial Sequence: Synthetic polynucleotide
gaattcccgccgccaccatgggctggtcctgcatcatcctgttcctggtggccacagccaccggcgtgcacagcgagatcgtcctgacacagagcccagccaccctgagcctgagccccggcgagcgggccacactctcctgtagagcttctcagagcgtgtcctactacctggcctggtatcagcagaaacctggccaggcccctagactgctgatctacgacgcctttaaccgggccaccggcatccctgctagattcagcggcagcggatctggcacagatttcaccctgaccatcagcagcctggaacccgaggacttcgccgtgtactactgccagcaaagaatcaactggcctctgaccttcggcggcggaaccaaggtggaaattaagagaaccgtggccgcccctagcgtgttcatcttcccccccagcgacgagcagctgaagagcggtacagcttctgtggtgtgcctgctgaacaacttctacccgcgggaagccaaggtgcagtggaaggtggacaacgccctgcagagcggcaacagccaggagagcgtgacagagcaggacagcaaggacagcacctacagcctgagcagcaccctgaccctgagcaaggccgactacgagaagcacaaggtgtacgcctgtgaagtgacccaccagggcctgtctagccctgtgaccaagtcttttaacagaggcgagtgctgataagctt

SEQ ID NO: 617 - DNA, 726 bp, Artificial Sequence; identical to SEQ ID NO: 616
  Description of Artificial Sequence: Synthetic polynucleotide

SEQ ID NO: 618 - DNA, 726 bp, Artificial Sequence; identical to SEQ ID NO: 616
  Description of Artificial Sequence: Synthetic polynucleotide

SEQ ID NO: 619 - DNA, 726 bp, Artificial Sequence; identical to SEQ ID NO: 616
  Description of Artificial Sequence: Synthetic polynucleotide

SEQ ID NO: 620 - DNA, 726 bp, Artificial Sequence
  Description of Artificial Sequence: Synthetic polynucleotide
gaattcccgccgccaccatgggctggtcctgcatcatcctgttcctggtggccacagccaccggcgtgcacagcgagatcgtgctgacacagtccccagctacactctccctgagccccggcgagcgggccaccctgtcttgtagagcttctcagagcgtgaactactacctggcctggtatcagcagaaacctggccaggcccctagactgctgatctacgacgcctttaaccgggccaccggcatccccgccagattcagcggcagcggcagcggaacagatttcaccctgaccatcagcagcctggaacctgaggacttcgccgtctactactgccagcaaagaatcagctggcctctgaccttcggcggcggaaccaaggtggaaattaagagaaccgtggccgcccctagcgtgttcatcttcccccccagcgacgagcagctgaagagcggtacagcttctgtggtgtgcctgctgaacaacttctacccgcgggaagccaaggtgcagtggaaggtggacaacgccctgcagagcggcaacagccaggagagcgtgacagagcaggacagcaaggacagcacctacagcctgagcagcaccctgaccctgagcaaggccgactacgagaagcacaaggtgtacgcctgtgaagtgacccaccagggcctgtctagccctgtgaccaagtcttttaacagaggcgagtgctgataagctt

SEQ ID NO: 621 - protein, 15 aa, Artificial Sequence
  Description of Artificial Sequence: Synthetic peptide
FKVATPYSLYVCPEG

SEQ ID NO: 622 - protein, 15 aa, Artificial Sequence
  Description of Artificial Sequence: Synthetic peptide
PYSLYVCPEGQNVTL

SEQ ID NO: 623 - protein, 15 aa, Artificial Sequence
  Description of Artificial Sequence: Synthetic peptide
VCPEGQNVTLTCRLL

SEQ ID NO: 624 - protein, 15 aa, Artificial Sequence
  Description of Artificial Sequence: Synthetic peptide
QNVTLTCRLLGPVDK

SEQ ID NO: 625 - protein, 15 aa, Artificial Sequence
  Description of Artificial Sequence: Synthetic peptide
TCRLLGPVDKGHDVT

SEQ ID NO: 626 - protein, 15 aa, Artificial Sequence
  Description of Artificial Sequence: Synthetic peptide
GPVDKGHDVTFYKTW

SEQ ID NO: 627 - protein, 15 aa, Artificial Sequence
  Description of Artificial Sequence: Synthetic peptide
GHDVTFYKTWYRSSR

SEQ ID NO: 628 - protein, 15 aa, Artificial Sequence
  Description of Artificial Sequence: Synthetic peptide
FYKTWYRSSRGEVQT

SEQ ID NO: 629 - protein, 15 aa, Artificial Sequence
  Description of Artificial Sequence: Synthetic peptide
YRSSRGEVQTCSERR

SEQ ID NO: 630 - protein, 15 aa, Artificial Sequence
  Description of Artificial Sequence: Synthetic peptide
GEVQTCSERRPIRNL

SEQ ID NO: 631 - protein, 15 aa, Artificial Sequence
  Description of Artificial Sequence: Synthetic peptide
CSERRPIRNLTFQDL

SEQ ID NO: 632 - protein, 15 aa, Artificial Sequence
  Description of Artificial Sequence: Synthetic peptide
PIRNLTFQDLHLHHG

SEQ ID NO: 633 - protein, 15 aa, Artificial Sequence
  Description of Artificial Sequence: Synthetic peptide
TFQDLHLHHGGHQAA

SEQ ID NO: 634 - protein, 15 aa, Artificial Sequence
  Description of Artificial Sequence: Synthetic peptide
HLHHGGHQAANTSHD

SEQ ID NO: 635 - protein, 15 aa, Artificial Sequence
  Description of Artificial Sequence: Synthetic peptide
GHQAANTSHDLAQRH

SEQ ID NO: 636 - protein, 15 aa, Artificial Sequence
  Description of Artificial Sequence: Synthetic peptide
NTSHDLAQRHGLESA

SEQ ID NO: 637 - protein, 15 aa, Artificial Sequence
  Description of Artificial Sequence: Synthetic peptide
LAQRHGLESASDHHG

SEQ ID NO: 638 - protein, 15 aa, Artificial Sequence
  Description of Artificial Sequence: Synthetic peptide
GLESASDHHGNFSIT

SEQ ID NO: 639 - protein, 15 aa, Artificial Sequence
  Description of Artificial Sequence: Synthetic peptide
SDHHGNFSITMRNLT

SEQ ID NO: 640 - protein, 15 aa, Artificial Sequence
  Description of Artificial Sequence: Synthetic peptide
NFSITMRNLTLLDSG

SEQ ID NO: 641 - protein, 15 aa, Artificial Sequence
  Description of Artificial Sequence: Synthetic peptide
MRNLTLLDSGLYCCL

SEQ ID NO: 642 - protein, 15 aa, Artificial Sequence
  Description of Artificial Sequence: Synthetic peptide
LLDSGLYCCLVVEIR

SEQ ID NO: 643 - protein, 15 aa, Artificial Sequence
  Description of Artificial Sequence: Synthetic peptide
LYCCLVVEIRHHHSE

SEQ ID NO: 644 - protein, 15 aa, Artificial Sequence
  Description of Artificial Sequence: Synthetic peptide
VVEIRHHHSEHRVHG

SEQ ID NO: 645 - protein, 15 aa, Artificial Sequence
  Description of Artificial Sequence: Synthetic peptide
HHHSEHRVHGAMELQ

SEQ ID NO: 646 - protein, 15 aa, Artificial Sequence
  Description of Artificial Sequence: Synthetic peptide
HRVHGAMELQVQTGK

SEQ ID NO: 647 - protein, 15 aa, Artificial Sequence
  Description of Artificial Sequence: Synthetic peptide
AMELQVQTGKDAPSN

SEQ ID NO: 648 - protein, 15 aa, Artificial Sequence
  Description of Artificial Sequence: Synthetic peptide
VQTGKDAPSNCVVYP

SEQ ID NO: 649 - protein, 15 aa, Artificial Sequence
  Description of Artificial Sequence: Synthetic peptide
DAPSNCVVYPSSSQE

SEQ ID NO: 650 - protein, 15 aa, Artificial Sequence
  Description of Artificial Sequence: Synthetic peptide
CVVYPSSSQESENIT

SEQ ID NO: 651 - protein, 12 aa, Artificial Sequence
  Description of Artificial Sequence: Synthetic peptide
SSSQESENITAA

SEQ ID NO: 652 - DNA, 705 bp, Artificial Sequence
  Description of Artificial Sequence: Synthetic polynucleotide
atggagtggtcctgggtgttcctgttcttcctgtcggtgaccaccggcgtgcactccgaaattgtgctgactcagagcccagctaccctttccctgtccccgggagaaagagccaccctctcatgtcgcgcctcccaatccgtgtcctactacctggcctggtatcagcagaagcctggacaggcaccgaggctgctcatctacgacgcgttcaaccgggccactggcattccggcccgctttagcggatcaggttccggcactgatttcaccctgaccatctcatccctggagcccgaagatttcgccgtctactactgccaacagcgcatcaattggcctctcactttcggtggcgggacaaaggtcgagatcaagagaaccgtggcagctccctcggtgttcatcttcccgccctcggacgaacagctgaagtccggaactgcctcggtcgtgtgcctgctcaacaacttttaccctcgggaggccaaagtgcagtggaaagtggacaacgcgctgcagtccggaaactcacaggaaagcgtgacggagcaggattccaaggacagcacttactcgttgagcagcacccttaccctgagcaaggcggactacgaaaagcacaaggtctacgcctgcgaagtgacccatcaaggattgtcctcccccgtgaccaagtctttcaaccggggggagtgctaatga

SEQ ID NO: 653 - DNA, 1404 bp, Artificial Sequence
  Description of Artificial Sequence: Synthetic polynucleotide
atggaatggtcctgggtgttcctcttcttcctctccgtgaccactggcgtgcacagccaagtgcagctgcaagaatccggtcctgggcttgtgaagccgtcggagactctgtccctcacttgcaccgtgtccggagggagcatttcgagctactactggtcatggattaggcagccgccagggaagggactggagtggatcggctacatctactactccggctccaccaactataacccgagcctgaagtcccgcgtcaccatctccgtggacacctccaagtcgcaattcagcctgaagctgagcagtgtgactgccgccgatactgctgtctactactgcgcgcgggacattccggcgttcgcctttgacatctggggccagggaactatggtcatcgtgtcatccgcctcgaccaagggcccctcggtgttcccccttgccccgtcatccaagtcaacctcgggtggaactgcggcccttggatgcctcgtgaaggactatttcccggaacctgtgaccgtgtcctggaactccggagccctgacctccggtgtccacacattccccgccgtgttgcaatcctccggactgtacagcctgtcaagcgtcgtgaccgtgccgtcgagctcgctcggaacccagacgtacatctgcaacgtgaaccacaagccgtccaacaccaaggtcgacaagaaggtcgagcctaagtcctgcgacaagacgcatacctgtccaccatgtccggcaccagaactgctgggaggtcccagcgtgtttctgttcccgcccaaacctaaggataccctgtacatcaccagagagcccgaagtgacctgtgtggtggtggacgtgtcccacgaggatcctgaagtcaagttcaattggtacgtggatggcgtggaggtgcacaacgccaagaccaagccccgggaagaacagtacaattccacttatcgggttgtgtcggtcctcaccgtgctgcatcaggactggctcaacggaaaggagtacaagtgcaaagtgtcgaacaaggctctgcccgcacctattgaaaagactatcagcaaggccaaagggcagccgagagagccccaggtctacaccctgcctccatcccgcgacgagttgaccaagaaccaagtgtccctgacttgcctggtcaagggcttctacccttctgacatcgcggtggaatgggagagcaacggccagcccgagaacaactacaagactaccccgcctgtactggacagcgacggctcattcttcctgtactcgaagctgaccgtggataagtctaggtggcagcaggggaacgtgttctcctgctccgtcatgcacgaagccctccataaccactacacccagaagtcactgtccttgtcccctggaaaatgataa

SEQ ID NO: 654 - DNA, 1395 bp, Artificial Sequence
  Description of Artificial Sequence: Synthetic polynucleotide
atggaatggtcctgggtgttcctcttcttcctctccgtgaccactggcgtgcacagccaagtgcagctgcaagaatccggtcctgggcttgtgaagccgtcggagactctgtccctcacttgcaccgtgtccggagggagcatttcgagctactactggtcatggattaggcagccgccagggaagggactggagtggatcggctacatctactactccggctccaccaactataacccgagcctgaagtcccgcgtcaccatctccgtggacacctccaagtcgcaattcagcctgaagctgagcagtgtgactgccgccgatactgctgtctactactgcgcgcgggacattccggcgttcgcctttgacatctggggccagggaactatggtcatcgtgtcatccgcctcgaccaagggcccctcggtgttcccccttgccccgtgttcccgctcaacctcggagagcactgcggcccttggatgcctcgtgaaggactatttcccggaacctgtgaccgtgtcctggaactccggagccctgacctccggtgtccacacattccccgccgtgttgcaatcctccggactgtacagcctgtcaagcgtcgtgaccgtgccgtcgagctcgctcggaaccaagacgtacacttgcaacgtggaccacaagccgtccaacaccaaggtcgacaagagagtcgagtctaagtacggacctccttgtccaccatgtccggcaccagaatttctgggaggtcccagcgtgtttctgttcccgcccaaacctaaggataccctgatgatctcaagaacccccgaagtgacctgtgtggtggtggacgtgtcccaggaggatcctgaagtccagttcaattggtacgtggatggcgtggaggtgcacaacgccaagaccaagccccgggaagaacagttcaattccacttatcgggttgtgtcggtcctcaccgtgctgcatcaggactggctcaacggaaaggagtacaagtgcaaagtgtcgaacaagggactgccctcctccattgaaaagactatcagcaaggccaaagggcagccgagagagccccaggtctacaccctgcctccatcccaagaggagatgaccaagaaccaagtgtccctgacttgcctggtcaagggcttctacccttctgacatcgcggtggaatgggagagcaacggccagcccgagaacaactacaagactaccccgcctgtactggacagcgacggctcattcttcctgtactcgcgcctgaccgtggataagtctaggtggcaggaagggaacgtgttctcctgctccgtcatgcacgaagccctccataaccactacacccagaagtcactgtccttgtccttgggaaaatgataa

What is claimed is:

1. An antibody, or antigen-binding fragment thereof, that binds to VISTA, wherein the antibody or antigen-binding fragment thereof, comprises a VH and a VL,
- wherein the VH comprises:
  - a VH CDR1 of SEQ ID NO: 249 as defined by Kabat numbering system,
  - a VH CDR2 of SEQ ID NO: 256 as defined by Kabat numbering system,
  - a VH CDR3 of SEQ ID NO: 268 as defined by Kabat numbering system, and
- wherein the VL comprises:
  - a VL CDR1 of SEQ ID NO: 113 as defined by Kabat numbering system,
  - a VL CDR2 of SEQ ID NO: 125 as defined by Kabat numbering system, and
  - a VL CDR3 of SEQ ID NO: 134 as defined by Kabat numbering system.

2. The antibody, or antigen-binding fragment thereof, of claim 1,
- wherein the VH comprises a sequence having at least 90%, 91%, 92%, 93%, 94%, 95%, 96%, 97%, 98%, or 99% identity to SEQ ID NO: 592, and
- wherein the VL comprises a sequence having at least 90%, 91%, 92%, 93%, 94%, 95%, 96%, 97%, 98%, or 99% identity to SEQ ID NO: 86.

3. The antibody, or antigen-binding fragment thereof, of claim 2,
- wherein the VH comprises or consists of SEQ ID NO: 592, and
- wherein the VL comprises or consists of SEQ ID NO: 86.

4. The antibody, or antigen-binding fragment thereof, of claim 1,
- comprising a heavy chain (HC) sequence having at least 90%, 91%, 92%, 93%, 94%, 95%, 96%, 97%, 98%, or 99% identity to, comprises, or consists of SEQ ID NO: 573, and
- comprising a light chain (LC) sequence having at least 90%, 91%, 92%, 93%, 94%, 95%, 96%, 97%, 98%, or 99% identity to, comprises, or consists of SEQ ID NO: 391.

5. The antibody, or antigen-binding fragment thereof, of claim 1,
- which binds to an epitope of human VISTA comprising Tyrosine 37, Arginine 54, Valine 117 and Arginine 127 of SEQ ID NO: 377 (respectively amino acids 69, 86, 149 and 159 of SEQ ID NO: 377).

6. The antibody, or antigen-binding fragment thereof, of claim 1, comprising an Fc region.

7. The antibody, or antigen-binding fragment, of claim 6, wherein
- (a) the Fc region is of a human IgG1, and wherein the mutations are selected from the group consisting of C220D, D221C, E233P, L234A, L234E, L234Y, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, E318A, K322A, S324T, K326A, K326M, L328R, P329A, P329G, A330L, A330S, P331A, P331S, I332E, E333A, E333S, K334A, A378V, S383N, M428L, N434S, and N434Y, wherein the residues are numbered using the EU numbering system;
- (b) the Fc region is of a human IgG2, and wherein the mutations are selected from the group consisting of C220D, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, A330L, A330S, P331A, P331S, I332E, E333A, E333S, K334A, S383N, M428L, N434S, and N434Y, wherein the residues are numbered using the EU numbering system; or
- (c) the Fc region is of a human IgG4, and wherein the mutations are selected from the group consisting of S228P, E233P, F234A, L235A, L235E, L235F, G236A, G236W, G236R, G237A, P238S, S239D, F241A, M252Y, S254T, T256E, T256N, V264A, D265A, S267E, H268F, H268A, D270A, H268Q, E294deletion, N297A, N297G, N297E, S298A, T307P, V309L, E318A, K322A, S324T, K326A, K326M, L328R, P329A, P329G, I332E, E333A, E333S, K334A, A378V, S383N, M428L, N434S, and N434Y, wherein the residues are numbered using the EU numbering system.

8. The antibody, or antigen-binding fragment thereof, of claim 1, which is a bispecific antibody or a multispecific antibody.

9. The antibody, or antigen-binding fragment thereof, of claim 1, wherein the antigen-binding fragment is an Fv fragment, a Fab fragment, a F(ab')2 fragment, or a single-chain Fv (scFv).

10. A pharmaceutical composition comprising the antibody, or antigen-binding fragment thereof, of claim 1 and a pharmaceutically acceptable carrier.

11. A method of treating cancer, an autoimmune disease, and/or an infection in a subject in need thereof, comprising administering to the subject the pharmaceutical composition of claim 10.

12. The method of claim 11, wherein the cancer is a non-small cell lung cancer, small cell lung cancer, a head and neck squamous cell carcinoma, an hepatocellular carcinoma, an ovarian cancer, a neuroblastoma, an oral cancer, a thyroid cancer, a breast cancer, a sarcoma, a pancreatic cancer, a colon cancer, a gastric cancer, a choriocarcinoma, a testicular cancer, a mesothelioma, a skin cancer, a renal cell carcinoma, a bladder cancer, a hematological cancer, a cervical cancer, a blood cancer, an acute myeloid leukemia, myelodysplastic syndrome, and/or a metastatic cancer.

13. The method of claim 11, wherein the method further comprises administering to the subject an additional therapy.

14. The method of claim 13, wherein the immune checkpoint inhibitor is an inhibitor of Programmed Death-1 (PD-1), or Programmed death-ligand 1 (PDL1), or cytotoxic T-lymphocyte-associated protein 4 (CTLA-4), or lymphocyte-activation gene 3 (LAG-3).

15. The antibody, or antigen-binding fragment thereof, of claim 6, wherein the Fc region is a human Fc region, or a variant of the human Fc region that has in the range of one to seven amino acid mutations in the Fc region relative to the native human Fc region.

16. The antibody, or antigen-binding fragment thereof, of claim 15, wherein the human Fc region is a human IgG1 region, a human IgG2 region, or a human IgG4 region.

17. The antibody, or antigen-binding fragment thereof, of claim 6, wherein the antibody comprises a constant region of a human IgG1 or a human IgG4, or a variant of the constant region that has in the range of one to seven amino acid mutations in the constant region relative to the native constant region.

18. The method of claim 13, wherein the additional therapy is radiotherapy, a chemotherapeutic agent, a targeted therapy, a tyrosine kinase inhibitor, hormone therapy, and/or an immune checkpoint inhibitor.

* * * * *